(12) United States Patent
Volkert et al.

(10) Patent No.: US 7,560,233 B2
(45) Date of Patent: Jul. 14, 2009

(54) OXIDATIVE DNA DAMAGE PROTECTION

(75) Inventors: Michael Volkert, West Boylston, MA (US); Jen-Yeu Wang, Taipei (TW)

(73) Assignee: University of Massachusetts, Boston, MA (US)

( * ) Notice: Subject to any disclaimer, the term of this patent is extended or adjusted under 35 U.S.C. 154(b) by 232 days.

(21) Appl. No.: 11/154,012

(22) Filed: Jun. 16, 2005

(65) Prior Publication Data

US 2006/0078911 A1 Apr. 13, 2006

Related U.S. Application Data

(60) Provisional application No. 60/580,476, filed on Jun. 16, 2004.

(51) Int. Cl.
*C12Q 1/68* (2006.01)
*C12Q 1/02* (2006.01)

(52) U.S. Cl. .............................. 435/6; 435/29
(58) Field of Classification Search ................. None
See application file for complete search history.

(56) References Cited

OTHER PUBLICATIONS

Bradsher et al., "CSB is a Component of RNA Pol I Transcription," Mol. Cell., 10:819-29 (2000).
Brandsen et al., "C-Terminal domain of transcription cofactor PC4 reveals dimeric ssDNA binding site," Nat. Struc. Biol., 4:900-3 (1997).
Cunningham and Weiss, "Endonuclease III (*nth*) mutants of *Escherichia coli*," Proc. Natl. Acad. Sci. USA, 82:474-478 (1985).
Cupples and Miller, "A set of *lacZ* mutations in *Escherichia coli* that allow rapid detection of each of the six base substitutions," Proc. Natl. Acad. Sci. USA, 86:5345-5349 (1989).
Elliott and Volkert, "Stress induction and mitochondrial localization of Oxr1 proteins in yeast and humans," Mol. Cell. Biol., 24:3180-87 (2004).
Ge et al., "Activator-Dependent Transcription by Mammalian RNA Polymerase II: In Vitro Reconstitution with General Transcription Factors and Cofactors," Methods Enzymol., 274:57-71 (1996).
Ge et al., "Purification, Cloning, and Characterization of a Human Coactivator, PC4, that Mediates Transcriptional Activation of Class II Genes," Cell, 78:513-23 (1994).
Griffith and Wolf, "Measuring β-Galactosidase Activity in Bacteria: Cell Growth, Permeabilization, and Enzyme Assays in 96-Well Arrays," Biochem. Biophys. Res. Comm., 290:397-402 (2002).
Holloway et al., "Functional Interaction between the HIV Transactivator Tat and the Transcriptional Coactivator PC4 in T cells," J. Biol. Chem., 275:21668-77 (2000).
Horst et al., "*Escherichia coli* mutator genes," Trends Microbiol., 7:29-36 (1999).
Kaiser et al., "The coactivator p15 (PC4) initiates transcriptional activation during TFIIA-TFIID-promoter complex formation," EMBO J., 14:3520-7 (1994).
Kretzschmar et al., "A novel mediator of class II gene transcription with homology to viral immediate-early transcriptional regulators," Cell, 78:525-34 (1994).
Le Page et al., "Transcription-coupled repair of 8-oxoguanine: requirement for XPG, TFIIH, and CSB and implications for Cockayne syndrome," Cell, 101: 159-71 (2000).
Lee et al., "Requirement of Yeast *RAD2*, a Homolog of Human *XPG* Gene, for Efficient RNA Polymerase II Transcription: Implications for Cockayne Syndrome," Cell, 109:823-34 (2002).
Li et al., "The role of human alkyladenine glycosylase in cellular resistance to the chloroethylnitrosoureas," Carcinogenesis, 24:589-93 (2003).
Michaels et al., "Evidence that MutY and MutM combine to prevent mutations by an oxidatively damaged form of guanine in DNA," Proc. Natl. Acad. Sci. USA, 89:7022-7025 (1992).
Michaels, et al., "MutM, a protein that prevents G:C→T:A transversions, is formamidopyrimidine-DNA glycosylase," Nucl. Acids Res., 19:3629-3632 (1991).
Modrich, "Methyl-directed DNA mismatch correction," J. Biol. Chem., 264:6597-600 (1989).
Ohtsubo et al., "Identification of human MutY homolog (hMYH) as a repair enzyme for 2-hydroxyadenine in DNA and detection of multiple forms of hMYH located in nuclei and mitochondria," Nucleic Acids Res., 28:1355-64 (2000)).
Raimondi et al., "Clinicopathologic manifestations and breakpoints of the t(3;5) in patients with acute nonlymphocytic leukemia," Leukemia, 3:42-47 (1989).
Rebeck and Samson, "Increased spontaneous mutation and alkylation sensitivity of *Escherichia coli* strains lacking the ogt $O^6$-methylguanine DNA repair methyltransferase," J. Bacteriol., 173:2068-76 (1991).
Reed et al., "The yeast *RAD7* and *RAD16* genes are required for postincision events during nucleotide excision repair. In vitro and in vivo studies with *rad7* and *rad 16* mutants and purification of a Rad7/Rad16-containing protein complex," J. Biol. Chem., 45:29481-8 (1998).
Sakumi et al., "Ogg1 knockout-associated lung tumorigenesis and its suppression by Mth1 gene disruption," Cancer Res., 63:902-5 (2003).
Sedgwick, "Nitrosated peptides and polyamines as endogenous mutagens in $O^6$-alkylguanine-DNA alkyltransferase deficient cells," Carcinogenesis, 18:1561-7 (1997).
Shao et al., "ERAP140, a conserved tissue-specific nuclear receptor coactivator," Mol. Cell Biol., 2:3358-72 (2002).

(Continued)

*Primary Examiner*—James Martinell
(74) *Attorney, Agent, or Firm*—Fish & Richardson P.C.

(57) ABSTRACT

Provided herein are methods of screening compounds, gene sequences, and gene products in bacteria for agents that are protective against oxidative DNA damage in a human or animal. Gene sequences identified by these screens can also be used in diagnostic assays that identify subjects at increased risk for oxidative DNA damage. Pharmaceutical compositions that include DNA protective agents identified by these screens are also provided.

22 Claims, 11 Drawing Sheets

OTHER PUBLICATIONS

Takao et al., "Novel nuclear and mitochondrial glycosylases revealed by disruption of the mouse *Nth 1* gene encoding an endonuclease III homolog for repair of thymine glycols," EMBO J., 21:3486-93 (2002).

Taverna and Sedgwick, "Generation of an endogenous DNA-methylating agent by nitrosation in *Escherichia coli*," J. Bacteriol., 178:5105-11 (1996).

Tsuzuki et al., "Spontaneous tumorigenesis in mice defective in the *MTH1* gene encoding 8-oxo-dGTPase," Proc. Natl. Acad. Sci. USA, 98:11456-61 (2001).

van der Kemp et al., "Cloning and expression in *Escherichia coli* of the *OGG1* gene of *Saccharomyces cerevisiae*, which codes for a DNA glycosylase that excises 7,8-dihydro-8-oxoguanine and 2,6-diamino-4-hydroxy-5-*N*-methylformamidopyrimidine," Proc. Natl. Acad. Sci. USA, 93:5197-5202 (1996).

Van Poucke and Nelis, "Development of a Sensitive Chemiluminometric Assay for the Detection of β-Galactosidase in Permeabilized Coliform Bacteria and Comparison with Fluorometry and Colorimetry," Appl. Environ. Microbiol. 61:4505-09 (1995).

Volkert and Landini, "Transcriptional responses to DNA damage," Curr. Opin. Microbiol., 4:178-85 (2001).

Volkert et al., "Functional genomics reveals a family of eukaryotic oxidation protection genes," Proc. Natl. Acad. Sci. USA, 97:14530-535 (2000).

Wang et al., "The single-strand DNA binding activity of human PC4 prevents mutagenesis and killing by oxidative DNA damage," Mol. Cell. Biol., 24:6084-93 (2004).

Werten et al., "High-affinity DNA binding by the C-terminal domain of the transcriptional coactivator PC4 requires simultaneous interaction with two opposing unpaired strands and results in helix destabilization," J. Mol. Biol., 276:367-77 (1998).

Werten et al., "Interaction of PC4 with melted DNA inhibits transcription," EMBO J., 17:5103-11 (1998).

Wu et al., "Mutational analysis of yeast TFIIB: A functional relationship between Ssu72 and Sub1/Tsp1 defined by allele-specific interactions with TFIIB," Genetics, 153:643-52 (1999).

Yoneda-Kato et al., "Myeloid leukemia factor 1 regulates p53 by suppressing COP1 via COP9 signalosome subunit 3," EMBO J., 24:1739-49 (2005).

FIG. 1A
FIG. 1B
FIG. 1C
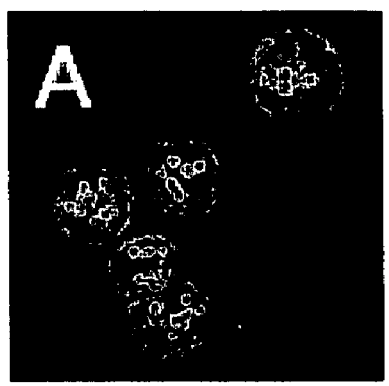
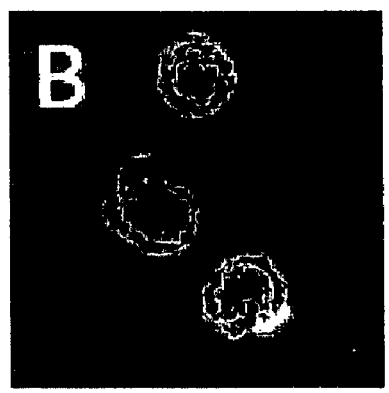
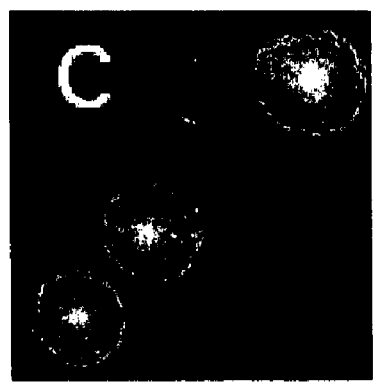
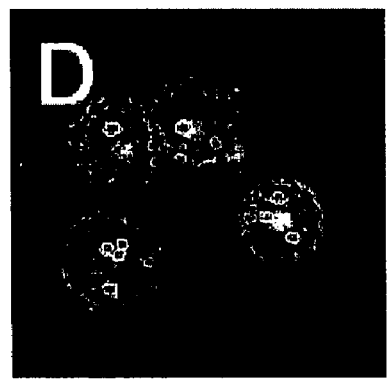
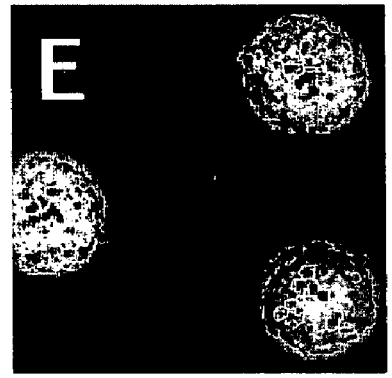
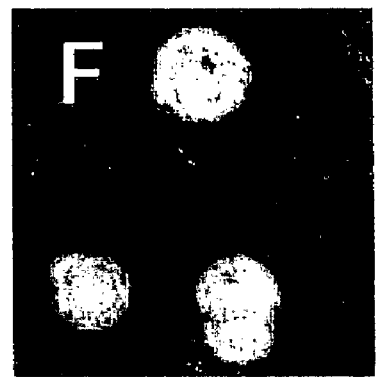
FIG. 1D
FIG. 1E
FIG. 1F atgcctaaatcaaggaactgtttcttcaggctctttctggcagtgattcctgacagt
gaggttgacaaaaagttaaagagaaagcaagtgctccagaaaacctgtaaag
aaacaaagacaggtgagacttcgagagccctgtcatcttctaaacagagcagcagc
agcagagatgataacatgtttcagattgggaaaatgaggtacgttagtgttcgcgat
tttaaggcaagtgctaattgatattagagatattggatccctgaaggtgaa
atgaaccagagaaagaaaaggtattttctttaaatccagaacaatggagccagctgaag
gaacagatttctgacattgatgatgcagtaagaaaactgtaa (SEQ ID NO:1)

FIG. 10A

MPKSKELVSSGSSSGSDSDSEVDKKLKRKKQVAPEKPVKKQKTGETSRAL
SSSKQSSSSRDDNMFQIGKMRYVSVRDFKGKVLIDIREYWMDPEGEMKP
GRKGISLNPEQWSQLKEQISDIDDAVRKL (SEQ ID NO:2)

FIG. 10B

OXIDATIVE DNA DAMAGE PROTECTION

CROSS-REFERENCE TO RELATED APPLICATIONS

This application claims the benefit of the priority date of U.S. Provisional Patent Application Ser. No. 60/580,476, filed on Jun. 16, 2004. The contents of this prior application are hereby incorporated by reference in their entirety.

STATEMENT OF FEDERALLY SPONSORED RESEARCH

This work was supported by NIH grants R01 GM56420 and R01 CA100122. The federal government has certain rights to this invention.

TECHNICAL FIELD

This invention relates to oxidative DNA damage, and more particularly to the use of bacteria to identify agents that can protect against oxidative DNA damage in a subject.

BACKGROUND

Oxidative DNA damage and the mutations it causes have been implicated in a number of human diseases, including cancer and neurodegenerative diseases. Oxidative DNA damage is also a contributing factor to aging. Oxidative DNA damage results from the interaction of reactive oxygen species (ROS) with DNA. ROS are produced as by-products of normal aerobic metabolism and by exogenous factors, such as ionizing radiation and chemical oxidants. The deleterious consequences of ROS are held in check by proteins that prevent or repair oxidative DNA damage. A balance between DNA repair and damage prevention mechanisms and ROS production is required to maintain a low spontaneous mutation rate. Factors that increase ROS production, reduce ROS detoxification, or affect repair of oxidative DNA lesions can result in increased mutagenesis.

SUMMARY

The invention is based, in part, on the discovery that mutant microbial strains, e.g., bacterial strains, that accumulate oxidative DNA lesions can be used in screening assays to identify compounds, genes, and gene products that are protective against oxidative DNA damage in a subject, e.g., a human or an animal. Compounds, genes, and gene products that are protective against DNA damage in bacteria can be protective in subjects, e.g., humans or animals, due to the conserved mechanisms of oxidative DNA damage and repair among bacteria and eukaryotes. The screens disclosed herein have the advantage of being adaptable to high throughput screening techniques. Compounds, genes, and gene products identified by the screens disclosed herein can be used as therapeutics, or to prepare therapeutic agents, to treat or prevent oxidative DNA damage in a subject. A number of such protective genes and gene products identified by the screens are disclosed. Genes identified in the screens disclosed herein can also be assayed in diagnostic tests to determine the susceptibility or propensity of an individual to an increased risk for oxidative DNA damage and/or disease condition associated with increased oxidative DNA damage.

This application includes methods of identifying agents that are protective against oxidative DNA damage, e.g., in a subject (e.g., a mammal or human), by: (i) obtaining a mutator microbial strain (e.g., a bacterial strain or yeast strain) that (a) has a spontaneous mutation rate and (b) comprises a mutation reporter; (ii) contacting the mutator microbial strain with a test compound; and (iii) evaluating the spontaneous mutation rate of the mutator strain; wherein a decrease in the spontaneous mutation rate indicates that the test compound is a candidate compound that is protective against oxidative DNA damage in a subject. The methods can further include testing the candidate compound in an animal model of oxidative DNA, wherein a candidate compound that prevents or reduces oxidative DNA damage in the animal model is a candidate protective agent against oxidative DNA damage.

In some embodiments, the mutation reporter includes the coding sequence for any one of the following: β-galactosidase, luciferase; green fluorescent protein, chloramphenicol, acetyltransferase, β-glucuronidase, exoglucanase and glucoamylase. In some embodiments, the reporter is a lacZ coding sequence that includes a substitution in the codon encoding amino acid residue Glu-461 of β-galactosidase.

Also included in this application are methods of identifying nucleic acid sequences that are protective against oxidative DNA damage by: (i) obtaining a collection of nucleic acid molecules encoding a plurality of gene products, e.g., representing at least 5 (e.g., at least 10, 20, 50, 75, 100, 200, 500, 1000, or 5000) different gene products; (ii) transforming the collection into a spontaneous mutator microbial strain (e.g., a bacterial strain or yeast strain) that (a) has a spontaneous mutation rate and (b) includes a mutation reporter; and (iii) screening individual transformants for a decrease in the spontaneous mutation rate of the mutator strain; wherein a transformant that exhibits a decreased spontaneous mutation rate indicates that the nucleic acid sequence is protective against oxidative damage. In some embodiments, the nucleic acid sequences are from a mammal or a human. The methods can be performed using high-throughput screening techniques, and each nucleic acid can include a human cDNA sequence. The gene sequences can be further characterized in a transformant with a decreased mutation rate.

In some embodiments, the mutation reporter includes the coding sequence for any one of the following: β-galactosidase, luciferase; green fluorescent protein, chloramphenicol, acetyltransferase, β-glucuronidase, exoglucanase and glucoamylase. In some embodiments, the reporter is a lacZ coding sequence that includes a substitution in the codon encoding amino acid residue Glu-461 of β-galactosidase.

In some embodiments, the invention includes isolated gene products encoded by gene sequences that are protective against oxidative damage, as identified by the methods disclosed herein. For example, the isolated gene products can be encoded by any of the genes set forth in Tables 3-5. The isolated gene products may be formulated into pharmaceutical compositions, lotions, e.g., suntan lotions, or sunscreens.

This application also includes methods of treating or preventing oxidative DNA damage in a subject by: (i) identifying a subject in need of treatment or protection against oxidative DNA damage; and (ii) administering to the subject an effective amount of a pharmaceutical composition that includes an isolated gene product encoded by a gene sequence that is protective against oxidative damage, e.g., a gene product encoded by a gene set forth in Tables 3-5, or a polypeptide that (a) include amino acid residues 40-127 of SEQ ID NO:2 or amino acid residues 40-127 of SEQ ID NO:2 with 8 or fewer (e.g., 7, 6, 5, 4, 3, 2, or 1) conservative amino acid substitutions; and (b) includes less than the full length sequence of SEQ ID NO:2.

This application also includes methods of identifying a subject at increased risk for oxidative DNA damage by: (i)

isolating and/or amplifying genetic material from the subject; and (ii) determining whether the genetic material of the subject harbors a mutant allele of a gene sequence that is protective against oxidative DNA damage, e.g., a gene sequence identified by the methods described herein, e.g., a gene sequence from Tables 3-5 or the PC4 gene; wherein a determination that the genomic material includes a mutant allele is an indication that the subject has an increased risk for oxidative DNA damage relative to a population of subjects with a normal allele of the gene sequence. The determination of whether the genetic material includes a mutant allele can include performing one or more of the following: direct DNA sequencing (DS), denaturing high performance liquid chromatography (DHPLC), single-strand conformation polymorphism (SSCP), denaturing gradient gel electrophoresis (DGGE), heteroduplex analysis (HA), fluorescent assisted mismatch analysis (FAMA), and the protein truncation test (PTT). The determination of whether the genetic material includes a mutant allele comprises determining whether the genetic material includes a marker linked to the mutant allele.

In another aspect, the invention also includes isolated polypeptides that (a) include amino acid residues 40-127 of SEQ ID NO:2 or amino acid residues 40-127 of SEQ ID NO:2 with fewer than 8 conservative amino acid substitutions; and (b) includes less than the full length sequence of SEQ ID NO:2. Also included are isolated nucleic acids that encode the polypeptides, and pharmaceutical compositions, sunscreens, and suntan lotions that include the polypeptides.

The invention also includes isolated polypeptides that are encoded by the genes set forth in Tables 3-5. Also included are isolated nucleic acids that encode the polypeptides, and pharmaceutical compositions, sunscreens, and suntan lotions that include the polypeptides.

A "subject" can be a human or an animal, e.g., a mammal such as a mouse, rat, guinea pig, hamster, dog, cat, pig, horse, goat, cow, monkey, or ape.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

Other features and advantages of the invention will be apparent from the following detailed description, and from the claims.

DESCRIPTION OF DRAWINGS

FIGS. 1A-1F are a series of photographic panels of different bacterial strains: FIG. 1A shows colonies of wild type *Escherichia coli* carrying the cc104 allele of lacZ, (lacZ revertants appear as dark papillae; FIGS. 1B-1F show colonies of an isogenic fpg mutY double mutant derivative of the strain in FIG. 1A; FIG. 1B shows the mutator phenotype of the mutator strain as evidenced by a much larger number of revertants/dark papillae; FIG. 1C shows suppression of the mutator phenotype of the fpg mutY double mutant by expression of bacterial Fpg protein (*E. coli* fpg mutY/pFpg); FIG. 1D shows suppression of the mutator phenotype by expression of the human 8-oxoG DNA glycosylase OGG1 (*E. coli* fpg mutY/phOGG1); FIG. 1E shows suppression of the mutator phenotype by expression of the human MutY ortholog hMYH (*E. coli* fpg mutY/phMYH); and FIG. 1F shows suppression of the mutator phenotype by expression of the truncated form of PC4 isolated in this study (*E. coli* fpg mutY/pSE380-PC4).

FIG. 10A is a nucleic acid sequence (SEQ ID NO:1) encoding the PC4 polypeptide (GENBANK® Accession No. NM_006713).

FIG. 10B is the amino acid sequence (SEQ ID NO:2) of the PC4 polypeptide (GENBANK® Accession No. NP_006704).

DETAILED DESCRIPTION

Figure 2:
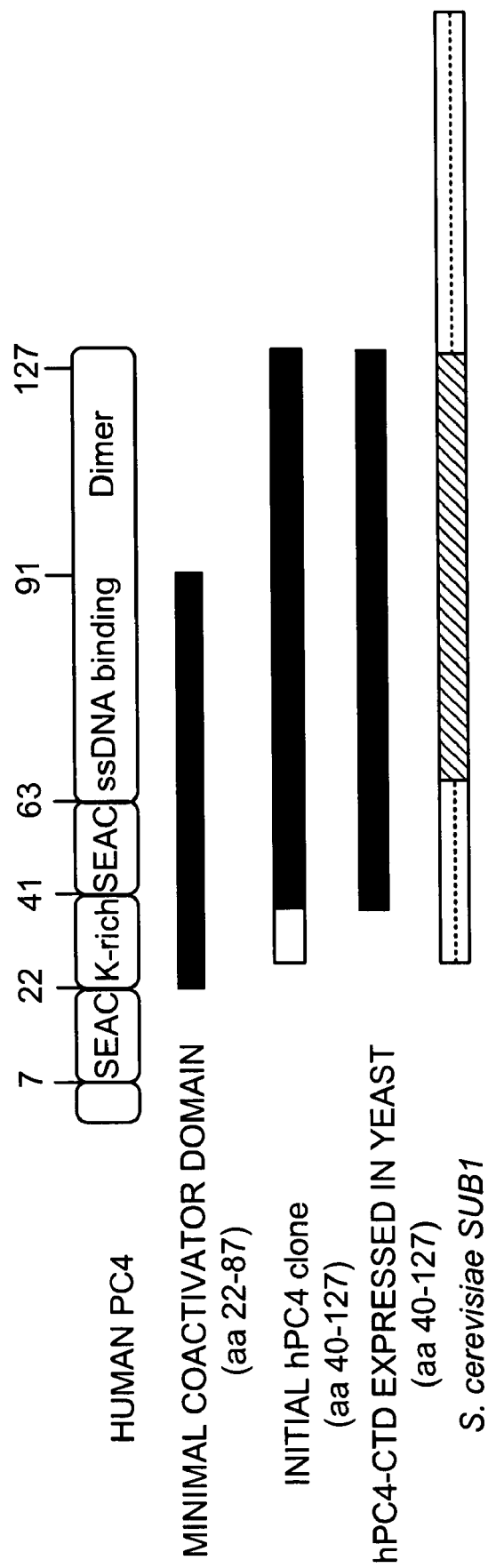
FIG. 2 is a representation of the structure of PC4 and its derivatives described herein. The upper panel shows the domains of wild type PC4. The protein region designated amino acid residues 22-87 is the minimal coactivator clone. The initial PC4 clone is the form of PC4 initially isolated in the screens described herein. The white amino-terminal box indicates the in frame vector sequence fused to the 40-127 amino acid residue region of PC4. The PC4-CTD expressed in yeast was constructed by adding an ATG codon 5' to sequences encoding PC4 amino acid residues 40 through 127. The *S. cerevisiae* SUB1 gene is also shown, the boxes containing the dotted lines (not to scale) depict the heterologous 39 amino acid residue amino-terminal and 187 amino acid residue carboxyl-terminal domains of unknown function.

Mutator bacterial strains are used in screens to identify agents, e.g., compounds, genes, and gene products, that are protective against oxidative DNA damage in a subject. Agents that are protective against oxidative DNA damage in bacteria can be protective against oxidative DNA damage in a subject due to the conserved mechanisms of oxidative DNA damage and repair between bacteria and eukaryotes (for review see: Friedberg et al., DNA Repair and Mutagenesis, 1995, American Society for Microbiology, Washington, D.C.). The mutator bacterial strains described herein harbor mutations in one or more genes that prevent or repair DNA oxidative damage in bacteria. Accumulation of oxidative lesions in their DNA causes these mutator strains to display an increased rate of mutagenesis. The mutator bacterial strains described herein also carry a mutation reporter that signals the mutation rate in the bacteria. The reporters used herein can signal the mutation rate of a bacterial strain within a single colony, i.e., the reporters can be used to gauge the mutation rate within a mutator bacterial strain without the need for replica plating or screening the survival rate of multiple, isolated bacterial colonies. Thus, the mutator strains and their mutation reporters described herein can be used in screening assays that are readily adaptable to high throughput screening methods.

In some of the screening assays described herein mutator bacteria are exposed to test compounds, and compounds that reduce the mutation rate of a mutator strain are considered protective agents that can reduce or prevent oxidative DNA damage in a subject. In some screening assays described herein, mutator bacteria are also transformed with nucleic acids, and nucleic acids that reduce the mutation rate of mutator strains are considered protective nucleic acids against oxidative DNA damage.

Test compounds suitable for screening in the methods disclosed herein include, but are not limited to, libraries of compounds (e.g., small molecules), peptide libraries, or libraries of peptide analogs. Nucleic acids that can be screened in the methods disclosed herein include, for example, animal or human cDNA libraries. The compounds, nucleic acid sequences, and gene products identified by these screens can be used as therapeutics or used to prepare therapeutic agents to protect against oxidative DNA damage in a subject. Genes identified by these methods can also be used in further screening assays to identify therapeutics protective against oxidation. Additionally, nucleic acid sequences identified by the screens described herein, or the complements thereof, can be used in diagnostic tests to determine the susceptibility of a subject to oxidative DNA damage, which can lead to cancer and/or neurodegenerative disorders.

Spontaneous Mutator Strains of Escherichia coli

The new screening assays described herein use oxidative repair deficient strains of Escherichia coli. These strains are referred to herein as "spontaneous mutator strains," or "mutator strains" because their inability to repair oxidative DNA damage results in an elevated spontaneous mutation rate. These strains can be used in screening assays adaptable for high throughput screening assays to identify human or animal genes and/or compounds that are protective against oxidative DNA damage in a subject.

Mutator strains carry defects in any one or more of the following genes: mutH, nth, nei, mutY, and fpg. See, e.g., Cupples, C. G., and J. H. Miller, Proc. Natl. Acad. Sci. USA 86:5345-5349 (1989); Michaels et al., Proc. Natl. Acad. Sci. USA, 89:7022-7025 (1992); Cunningham and Weiss, Proc. Natl. Acad. Sci. USA, 82:474-478 (1985), Modrich, P., J. Biol. Chem., 264:6597-600 (1989). Table 1, below, shows a number of mutator strains that are suitable for use in the screening methods disclosed herein. The defective genes responsible for the mutator phonotype of these strains are listed in the first column under "Repair Deficiency" heading.

TABLE 1

Oxidative Repair deficient strains of *E. coli* constructed for assessment of lacZ specific reversion

| | parent strain | | | | | | |
|---|---|---|---|---|---|---|---|
| | MV4500 | MV4501 | MV4502 | MV4503 | MV4504 | MV4505 | MV4506 |
| Repair Deficiency | amber suppression | TA → GC | GC → AT | CG → GC | GC → TA | TA → AT | AT → GC |
| mutH | MV4507 | MV4508 | MV4509 | MV4510 | MV4511 | MV4512 | MV4513 |
| nth | MV4514 | MV4515 | MV4516 | MV4517 | MV4518 | MV4519 | MV4520 |
| nei | MV4528 | MV4529 | MV4530 | MV4531 | MV4532 | MV4533 | MV4534 |
| fpg nth | MV4535 | MV4536 | MV4537 | MV4538 | MV4539 | MV4540 | MV4541 |
| fpg nei | MV4542 | MV4543 | MV4544 | MV4545 | MV4546 | MV4547 | MV4548 |
| nth nei | MV4549 | MV4550 | MV4551 | MV4552 | MV4553 | MV4554 | MV4555 |
| fpg nth nei | MV4556 | MV4557 | MV4558 | MV4559 | MV4560 | MV4561 | MV4562 |
| mutY nei | | | | | MV4710, 11 | | |
| fpg mutY | | | | | MV4708, 09 | | |
| fpg mutY nei | | | | | MV4712, 13 | | |
| fpg | | | | | MV4704, 05 | | |
| mutY | | | | | MV4706, 07 | | |

Any strain of bacteria, e.g., a strain of *E. coli*, *Salmonella typhimurium*, *Bacillus subtilis*, *Mycobacterium tuberculosis*, *Staphylococcus*, or *Streptococcus*, exhibiting an elevated spontaneous mutator phenotype can be used to search for genes involved in preventing or repairing the damage or replication errors leading to the mutation that occur within the particular strain. This can include, but is not limited to, use of strains with mutations in dam, mutH, mutL, mutS, or mutT; additionally an ada-ogt double mutant strain could be used in place of the fpg mutY strain (for review see: Horst et al., *Trends Microbiol.*, 7:29-36 (1999)). For example the ada-ogt double mutant strain produces GC→AT spontaneous transition mutations at a high rate because it is unable to counteract endogenous levels of spontaneous alkylation damage to DNA produced by amino acid nitrosation reactions and other endogenous alkylators (Rebeck and Samson, *J. Bacteriol.*, 173:2068-76 (1991); Sedgwick, *Carcinogenesis*, 18:1561-7 (1997); and Taverna and Sedgwick, *J. Bacteriol.*, 178:5105-11 (1996)).

Additionally strains that exhibit elevated mutation frequencies in response to specific DNA damaging agents can be employed in similar mutation assays by including low, sublethal, but mutagenic levels of specific DNA damaging agents in the indicator media. Plating of mutagen sensitive strains on mutagen containing plates produces colonies containing a dose dependent number of mutation reporter revertants, e.g., small, dark blue mutant microcolonies or papillae within the white Lac+ colony. Introduction of genes expressing proteins that specifically affect metabolic inactivation of the mutagen, or repair of the damage it produces will reduce the number of revertants, e.g., mutant papillae, in essentially the same way that oxidation resistance genes reduce spontaneous oxidative mutagenesis.

Many strains have been produced that show DNA damaging agent-dependent mutator phenotypes. For example, strains hypersensitive to alkylating agents include: MV1174 (alkA), MV2157 (alkA tag) MV3855 (alkA tag uvrA), MV3857 (alkA tag recA), MV3859 (alkA tag uvrA recA), MV4100 (alkA tag ada alkB), MV4106 (alkA tag ada alkB uvrA), MV4108 (alkA tag ada alkB uvrA recA). Strains hypersensitive to a wide variety of DNA damaging agents include MV1130 (uvrA), MV1169 (uvrA recA441). Such strains are hypermutable by DNA damaging agents such as UV, and most mutagens that produce bulky DNA adducts (for review see: Friedberg et al., *DNA Repair and Mutagenesis*, 1995, American Society for Microbiology, Washington, D.C.). Combinations of the above mutations and combinations of mutations by standard genetic means with mutation report genes, e.g., mutant lacZ, can produce strains suitable for use in genetic screens to determine DNA damage prevention and repair agents.

Assaying the Mutator Phenotype: Mutation Reporters

The new screening methods described herein use mutator bacterial strains that harbor at least one gene encoding an easily and readily scored mutation reporter, which means that the mutation reporters used in the new screening methods can be used to monitor the rate of mutation within a single bacterial colony or within a single liquid bacterial culture. Importantly, the mutation reporters used herein allow an observer to monitor the mutation rate of a bacterial strain harboring the mutation reporter without the need to perform time-consuming and cumbersome procedures, such as replica plating or monitoring the survival rate of multiple, isolated bacterial colonies. Thus, the mutation reporters described herein can also be used in high-throughput screening assays.

Mutation reporter genes, as used herein, are reporter genes with at least one mutation in the gene's coding sequence. The mutation alters the function of the encoded reporter gene product. The alteration in function can be easily and readily detected within a bacterial colony.

A well-known example of a bacterial reporter is β-galactosidase, encoded by the lacZ gene. One group of useful mutation reporter genes that can be used in the screens of the present invention are the six mutant lacZ genes, CC101-CC106 and described in Cupples and Miller, Proc. Natl. Acad. Sci. USA, 86:5345-5349 (1989). Each one of these mutant lacZ genes contains a point mutation in the Glu-461 codon that abrogates function of the encoded β-galactosidase gene product.

Bacterial cells harboring these lacZ mutations (and no wild type lacZ copy) are lac− and appear white when grown on indicator media containing 5-bromo-4-chloro-3-indolyl β-galactoside (X-Gal). A spontaneous mutation (more specifically, a transversion) in a bacterial host harboring a lacZ mutant can produce lacZ revertants encoding functional β-galactosidase. Such lacZ revertants are lac$^+$ and develop a blue color when grown on X-Gal indicator media.

Since mutator bacterial strains undergo more mutations than wild type bacterial strains, mutator bacterial strains tend to produce more functional lacZ revertants than wild type strains. The higher reversion rates of mutator bacterial strains lead to a greater number of cells in a population producing functional β-galactosidase relative to wild type strains. Thus, a mutator bacterial strain carrying a mutant reporter allele of the lacZ gene, e.g., any one of the CC101-CC106 genes, will undergo more reversion events and produce more functional β-galactosidase, compared to non-mutator strains carrying the same mutant lacZ gene.

There are many ways of measuring the rate of lacZ reversion in a bacterial strain. In one example, reversion rate can be scored by measuring the emergence of blue papillae in colonies grown on indicator media. Blue papillae within an otherwise white colony represent daughter cells, in which a transversion event has produced a functional lacZ gene. Because mutator strains undergo more reversion events, colonies of mutator strains carrying a mutant lacZ gene display a noticeably higher number of blue papillae relative to colonies of non-mutator strains carrying the same lacZ mutant. Furthermore, the number of blue papillae that emerge within a colony can be used to quantify the mutator phenotype of the bacterial host carrying a mutant lacZ gene. The strength of the mutator phenotype is directly proportional to the incidence of lacZ reversion, which is directly proportional to the number of blue papillae. The stronger the mutator phenotype, the greater the number of blue papillae that will be observed in colonies carrying the mutant lacZ gene.

The amount of functional β-galactosidase produced by bacterial strains can also be measured spectrophotometrically or by fluorescence. Functional β-galactosidase catalyzes the hydrolysis of o-nitrophenyl-β-D-galactopyranoside (ONPG) or chlorophenol red-β-D-galactopyranoside (CPRG) to yield colored products that can be quantified spectrophotometrically (Miller, J. H. 1972, Experiments in Molecular Genetics. Cold Spring Harbor Laboratories, Cold Spring Harbor, N.Y.; Miller, J. G. 1992. A short course in bacterial genetics: A laboratory manual and handbook for *Escherichia coli* and related bacteria. Cold Spring Harbor Laboratory Press, Cold Spring Harbor, N.Y.). β-galactosidase can also be measured using the fluorogenic substrates, 4-methyl umbelliferyl β-D-galactopyranoside (MUG) and fluorescein di(β-D-galactopyranoside) (FDG) (see, e.g., Eustace et al., Biotechniques, 11:739-742 (1991); Rakhmanova and MacDonald, Anal. Biochem., 257:234-7 (1998); and Young et al., Anal. Biochem., 215:24-30 (1993)).

Other Reporters

Any reporter whose function is altered by one or more point mutations can be used to screen reversion events in a bacterial host. The screening methods disclosed herein can use any easily and readily detectable reporter, e.g., one whose function can be detected visually, using a spectrophotometer, or with a detector capable of measuring fluorescence. Such reporters include proteins that catalyze the production of visually, spectrophotometrically, and fluorescently detectable products. Reporters for use in the present screens also include proteins whose visual, spectrophotometric, or fluorescent properties can be altered by one or more point mutations.

Examples of reporters that can be used in the present invention include: bacterial luciferase, renilla luciferase, firefly luciferase, chloramphenicol acetyltransferase (CAT), green fluorescent protein (GFP), enhanced GFP and other GFP variants, blue fluorescent protein, cyan fluorescent protein, red fluorescent protein, and any other fluorescent protein. Each of these reporters can be used in a bacterial strain that does not already harbor a wild-type allele of a gene encoding the reporter.

Other reporters can be used to measure the strength of a mutator strain's phenotype in a manner analogous to the method described above for β-galactosidase. A mutant gene encoding a non-functional version of a reporter described herein can be introduced into a mutator strain, and the incidence of reversion to a functional gene can be monitored by screening for functional reporter activity. Alternatively, the mutant reporter gene can encode a reporter whose function is merely altered, and whose altered reporter function can be readily distinguished from a non-altered (e.g., revertant) reporter.

Many mutations in wild type GFP are known that alter the fluorescence characteristic of the protein. Fore example, substitution in wild type GFP of the serine at residue 65 with a threonine, alanine, glycine, cysteine, or leucine causes a loss of GFP's 395 nm excitation peak and a major increase in the remaining single absorbance peak at 489 nm. See generally, Lippincott-Schwartz and Patterson, Science, 300:87-91 (2003) and Cubitt et al., in Green Fluorescent Proteins, Sullivan, S. Ed. 58:19 (Academic Press, San Diego, Calif. (1997)). This shift in excitation peak can be readily detected. A mutant reporter can be engineered by substituting codon 65 of GFP with any codon that differs from serine by only one nucleotide and encodes a threonine, alanine, glycine, leucine, or cysteine codon.

Other mutation reporters can be engineered based on any of the following mutations that alter the function of GFP. For example, changing GFP's tyrosine 66 to histidine results in a shift of the excitation maximum to the ultraviolet range at 383 nm, and a shift of the emission maximum to blue at 448 nm. Substitution of serine 202 to phenylalanine and substitution of threonine 203 to isoleucine both cause the loss of excitation in the 475 nm region with preservation of 395 nm excitation. Glutamine 222 to glycine is associated with elimination of the 395 nm excitation of GFP. Valine 163 to arginine enhances the magnitude of the Ser 65 to Thr mutant and also increases the temperature tolerance for functional GFP expression.

Mutation reporters that can be used in the presently described screens include point mutations that alter other readily detectable characteristics of a reporter protein. In some examples, a mutation reporter includes mutations that alter thermal stability, that shift the functional temperature range of the reporter, or that alter pH sensitivity. Any mutant can be used, as long as the altered function can be easily and readily screened.

Complementation of the Mutator Phenotype Using Test Compounds

The screening methods disclosed herein are based, in part, on the discovery that *E. coli* can be used to easily and readily identify agents that are protective against oxidative DNA damage in a subject, e.g., a human or an animal. The mutator bacterial strains described herein accumulate oxidative DNA damage. Certain agents that are protective against oxidative DNA damage in a subject, e.g., protective compounds, protective genes, or protective gene products, also function to suppress oxidative DNA damage in bacteria and complement the mutator phenotype of bacterial strains disclosed herein.

Accordingly, the mutator strains and mutation reporter genes disclosed herein can be used to screen and identify compounds that are protective against oxidative DNA damage in an animal or in a human. This screen involves administering one or multiple test compounds to a mutator bacterial strain carrying a mutation reporter gene, monitoring the rate of reporter gene reversion (e.g., by measuring altered reporter activity), and then identifying which compound(s), if any, reduce the rate of reporter gene reversion.

For example, in some screens compounds are administered to E. coli carrying any one of the lacZ mutations cc-104-cc106. The rate of reversion of the lacZ gene is monitored by measuring the production of functional β-galactosidase. Functional β-galactosidase can be assayed in any of the methods described or referred to earlier, and/or by any of the high throughput methods described below. Compounds that reduce the rate of lacZ reversion are compounds that are protective against oxidative DNA damage in a subject.

Compounds that complement the mutator phenotype or "hits" can be small molecules, e.g., compounds that are members of a small molecule chemical library. As used herein, "small molecules" refers to small organic or inorganic molecules of molecular weight below about 3,000 Daltons. The small molecules can be, e.g., from at least about 100 Da to about 3,000 Da (e.g., between about 100 to about 3,000 Da, about 100 to about 2,500 Da, about 100 to about 2,000 Da, about 100 to about 1,750 Da, about 100 to about 1,500 Da, about 100 to about 1,250 Da, about 100 to about 1,000 Da, about 100 to about 750 Da, about 100 to about 500 Da, about 200 to about 1500, about 500 to about 1000, about 300 to about 1000 Da, or about 100 to about 250 Da.

The small molecules can be natural products, synthetic products, or members of a combinatorial chemistry library. A set of diverse molecules can be used to cover a variety of functions such as charge, aromaticity, hydrogen bonding, flexibility, size, length of side chain, hydrophobicity, and rigidity. Combinatorial techniques suitable for synthesizing small molecules are known in the art, e.g., as exemplified by Obrecht, D. and Villalgrodo, J. M., Solid-Supported Combinatorial and Parallel Synthesis of Small-Molecular-Weight Compound Libraries, Pergamon-Elsevier Science Limited (1998), and include those such as the "split and pool" or "parallel" synthesis techniques, solid-phase and solution-phase techniques, and encoding techniques (see, for example, Czarnik, A. W., Curr. Opin. Chem. Bio., (1997) 1, 60). In addition, a number of small molecule libraries are commercially available. A number of suitable small molecule test compounds are listed in U.S. Pat. No. 6,503,713, incorporated herein by reference in its entirety.

Compound libraries screened using the new methods can comprise a variety of types of test compounds. A given library can comprise a set of structurally related or unrelated test compounds. In some embodiments, the test compounds are peptide or peptidomimetic molecules. In some embodiments, test compounds include, but are not limited to, peptide analogs including peptides comprising non-naturally occurring amino acids, e.g., β-amino acids or β-substituted β-amino acids ("β³-amino acids"), phosphorous analogs of amino acids, such as α-aminophosphonic acids and α-aminophosphinic acids, or amino acids having non-peptide linkages, or other small organic molecules. In some embodiments, the test compounds are β-peptide molecules; peptidomimetics (e.g., peptoid oligomers, e.g., peptoid amide or ester analogues, β-peptides, D-peptides, L-peptides, oligourea or oligocarbamate); peptides (e.g., tripeptides, tetrapeptides, pentapeptides, hexapeptides, heptapeptides, octapeptides, nonapeptides, decapeptides, or larger, e.g., 20-mers or more); cyclic peptides; other non-natural or unnatural peptide-like structures; and inorganic molecules (e.g., heterocyclic ring molecules). In some embodiments, the test compounds are nucleic acids.

In some embodiments, the test compounds and libraries thereof can be obtained by systematically altering the structure of a first "hit" compound that complements the mutator phenotype, and correlating that structure to a resulting biological activity, e.g., a structure-activity relationship study. The biological activity of the structure-activity study can be suppression of the mutator phenotype or ability to suppress or prevent tumor formation in an animal model.

Such libraries can be obtained using any of the numerous approaches in combinatorial library methods known in the art, including: biological libraries; peptoid libraries (libraries of molecules having the functionalities of peptides, but with a novel, non-peptide backbone which are resistant to enzymatic degradation but which nevertheless remain bioactive; see, e.g., Zuckermann, et al., J. Med. Chem., 37:2678-85 (1994)); spatially addressable parallel solid phase or solution phase libraries; synthetic library methods requiring deconvolution; the "one-bead one-compound" library method; and synthetic library methods using affinity chromatography selection (Lam, K. S., Anticancer Drug Des. 12:145 (1997)). Examples of methods for the synthesis of molecular libraries can be found in the art, for example in: DeWitt et al., Proc. Natl. Acad. Sci. USA, 90:6909(1993); Erb et al., Proc. Natl. Acad. Sci. USA, 91:11422(1994); Zuckermann et al., J Med. Chem., 37:2678 (1994); Cho et al., Science, 261:1303 (1993); Carrell et al., Angew. Chem. Int. Ed. Engl., 33:2059 (1994); Carell et al., Angew. Chem. Int. Ed. Engl., 33:2061 (1994); and in Gallop et al., J. Med. Chem., 37:1233 (1994). Libraries of compounds can be presented in solution (e.g., Houghten (1992) Biotechniques, 13:412-421), or on beads (Lam (1991) Nature, 354:82-84), chips (Fodor (1993) Nature, 364:555-556), bacteria (Ladner, U.S. Pat. No. 5,223,409), spores (Ladner USP '409), plasmids (Cull et al. (1992) Proc. Natl. Acad. Sci. USA, 89:1865-1869) or on phage (Scott and Smith (1990) Science, 249:386-390; Devlin (1990) Science, 249: 404-406; Cwirla et al. (1990) Proc. Natl. Acad. Sci. USA, 87:6378-6382; Felici (1991) J. Mol. Biol., 222:301-310; Ladner supra.).

Small molecules identified as complementing the bacterial mutator phenotype can be selected and systematically altered, e.g., using rational design, to optimize binding affinity, avidity, specificity, or other parameters. Such optimization can also be screened for using the methods described herein. Thus, in one embodiment, the invention includes screening a first library of small molecules using the methods described herein, identifying one or more compounds that are "hits," i.e., complement (i.e., suppress) the bacterial phenotype, and subjecting those hits to systematic structural alteration to create a second library of compounds structurally related to the hit, and screening the second library using the methods described herein.

A variety of techniques useful for determining the structures of compounds that suppress the bacterial mutator phenotype are known, e.g., NMR, mass spectrometry, gas chromatography equipped with electron capture detectors, fluorescence, and absorption spectroscopy.

Suppression of the Mutator Phenotype Using Nucleic Acid Libraries

The mutator strains and mutation reporter genes disclosed herein can also be used to screen and identify animal and human gene sequences that are protective against oxidative DNA damage. These screening assays involve introducing libraries of human or animal gene sequences into mutator bacterial strains harboring a mutation reporter gene and screening for gene sequences that suppress the bacterial mutator phenotype.

In some examples, the screen involves introducing an animal or human cDNA bacterial expression library into a mutator strain carrying a mutation reporter gene, e.g., a gene encoding any of the mutation reporters described herein. The screen also involves monitoring the rate of reversion of the mutation reporter gene by measuring alterations in reporter activity (e.g., gain of reporter function activity) and identifying which bacteria harbor cDNA(s), if any, that reduce the rate of reporter gene reversion.

Human or animal cDNA bacterial expression libraries can be constructed, e.g., as described in Perkins et al., Proc. Natl. Acad. Sci. USA, 96:2204-2209 (1999) and Volkert et al., Proc. Natl. Acad. Sci. USA, 97:14530-14535 (1999). Human and animal cDNA bacterial expression libraries are also available from commercial vendors, e.g., Lambda ZAP® Libraries are available from Stratagene, La Jolla, Calif. The introduction of such libraries into a bacterial host is known to persons of skill in the art.

Human or animal gene sequences that reduce the rate of reporter gene reversion are considered to be suppressors of the bacterial mutator phenotype and protective against oxidative DNA damage.

High Throughput Assays of Reporter Gene Function

The screening methods described herein lend themselves to high throughput assays of reporter gene function. For example, screening of bacterial colonies transformed with cDNA libraries can be performed robotically using automated bacterial colony/plaque pickers. These automated machines capture images of bacterial colonies (or phage plaques) using cameras, and then use software programs to analyze individual colonies according to established criteria. These machines can discriminate bacterial colonies (or phage plaques) on the basis of their color or fluorescent properties, and are therefore suitable for screening mutator strains containing a mutation reporter that affects the color or fluorescence of host bacteria, e.g., β-galactosidase mutation reporters, GFP mutation reporters, or any other fluorescent mutation reporter. Examples of the automated colony/plaques pickers include GENETAC™ G3 library management system, Biorobotics BIOPICK™ (Genomic Solutions, Ann Arbor, Mich.), and MEGAPIX2 (Genetix USA, Inc. Boston, Mass.).

Other high throughput methods of screening mutation reporter activity can be performed by growing bacteria in separated medium containers. Mutator bacterial strains harboring a mutation reporter are transformed with an animal or human nucleic acid library, e.g., a cDNA library. Mutation reporter function is assayed to identify bacteria whose reversion rate is diminished, i.e., that display less altered reporter activity. Examples of separated media containers for use in high throughput screens include multi-well and microtiter plates.

In methods where complementation of mutator phenotype by cDNAs is screened, individual mutator bacterial colonies, each harboring a different expressible cDNA, are each placed into separate medium containers. Bacteria are grown in the containers and the ability of expressed cDNA to complement the mutator phenotype is assayed by measuring the amount of altered (e.g., functional) reporter produced. For example, a microplate reader can be used to monitor β-galactosidase or fluorescence reporter activity of each well in a microtiter or multi-well plate as described in Griffith and Wolf, Biochem. Biophys. Res. Comm., 290:397-402 (2002). One example of a microplate reader is the SPECTRAMAX® 340 PC, Molecular Dynamics Amersham Biosciences Piscataway, N.J.), although many others are commercially available, e.g., from Genomic Solutions, Ann Arbor, Mich. and Genetix USA, Inc. Boston, Mass.

In methods where the ability of a compound to complement the mutator phenotype is being measured, different containers of a multi-well or microtiter plate are inoculated with the same mutator bacteria, different compounds are added to different containers, and the ability of each compound to reduce the reversion rate of the mutation reporter gene is assayed using a microtiter or multi-well plate reader.

Characterizing Nucleic Acids that Complement Bacterial Mutator Phenotype

Human and animal nucleic acid sequences identified in the assays described herein as suppressors of the mutator phenotype can be further characterized in a number of ways. For example, cDNA identified in the screens can be sequenced using DNA sequencing methods, see, e.g., Current Protocols in Molecular Biology, John Wiley & Sons, New York, N.Y. (2003). The DNA sequence will reveal the coding sequence of a gene and the gene product that is protective against oxidative DNA damage in an animal and/or a human.

A number of human genes that have been identified as protective against oxidative DNA damage using the screens of the present invention are listed in Example 11. Many or all of these genes can be used in the applications for genes and genes products described herein.

Application for Genes and Gene Products Protective Against Oxidative DNA Damage: Gene Products as Therapeutic Agents Many nucleic acids that are protective against oxidative DNA damage effect this protection through encoded gene products that protect against oxidative damage. These encoded gene products can be produced in vivo or synthetically in vitro. Gene products that are protective against oxidative DNA damage can be harvested and used as therapeutic agents in the treatment of subjects who are at risk of oxidative DNA damage.

Nucleic acids that are protective against oxidative DNA damage, e.g., the nucleic acids can be cDNA, genomic DNA, synthetic DNA, or RNA, and can be double stranded or single stranded (i.e., either a sense or an antisense strand or both). Fragments of these molecules are also considered within the scope of the invention, and can be produced by, for example, the polymerase chain reaction (PCR) or generated by treatment with one or more restriction endonucleases. A ribonucleic acid (RNA) molecule can be produced by in vitro transcription. Preferably, the nucleic acid molecules encode polypeptides that, regardless of length, are soluble under normal physiological conditions.

Nucleic acids that are protective against oxidative DNA damage can contain naturally occurring sequences, or sequences that differ from those that occur naturally, but, due to the degeneracy of the genetic code, encode the same polypeptide (for example, the polypeptide SEQ ID NO:2 (FIG. 10B)). In addition, these nucleic acid molecules are not limited to coding sequences, e.g., they can include some or all of the non coding sequences that lie upstream or downstream from a coding sequence.

A nucleic acid that is protective against oxidative DNA damage can be identified based on its similarity to the relevant gene or protein, respectively. For example, the identification can be based on sequence identity. The invention features isolated nucleic acid molecules which are at least 50% (or 55%, 65%, 75%, 85%, 95%, or 98%) identical to: (a) a nucleic acid molecule that encodes the polypeptide of SEQ ID NO:2; (b) the nucleotide sequence of SEQ ID NO:1 (FIG. 10A); or (c) a nucleic acid molecule which includes amino acid residues 40-127 of SEQ ID NO:2 or amino acid residues 40-127 of SEQ ID NO:2 with 8 or fewer amino acid substitutions, e.g., conservative amino acid substitutions; and (b) includes less than the full length sequence of the SEQ ID NO:2.

The determination of percent identity between two sequences is accomplished using the mathematical algorithm of Karlin and Altschul, Proc. Natl. Acad. Sci. USA, 90, 5873-5877, 1993. Such an algorithm is incorporated into the BLASTN and BLASTP programs of Altschul et al. (1990) J. Mol. Biol., 215, 403-410. BLAST nucleotide searches are performed with the BLASTN program, score=100, wordlength=12. BLAST protein searches are performed with the BLASTP program, score=50, wordlength=3. To obtain gapped alignments for comparative purposes, Gapped BLAST is utilized as described in Altschul et al. (1997) Nucleic Acids Res., 25, 3389-3402. When utilizing BLAST and Gapped BLAST programs, the default parameters of the respective programs (e.g., XBLAST and NBLAST) are used (see ncbi.nlm.nih.gov).

Hybridization can also be used as a measure of homology between two nucleic acid sequences. A nucleic acid sequence, or a portion thereof, can be used as hybridization probe according to standard hybridization techniques. The hybridization of a probe to DNA from a test source (e.g., a mammalian cell) is an indication of the presence of DNA in the test source. Hybridization conditions are known to those skilled in the art and can be found in Current Protocols in Molecular Biology, John Wiley & Sons, N.Y., 6.3.1-6.3.6, 1991. Moderate hybridization conditions are defined as equivalent to hybridization in 2× sodium chloride/sodium citrate (SSC) at 30° C., followed by one or more washes in 1×SSC, 0.1% SDS at 50-60° C. Highly stringent conditions are defined as equivalent to hybridization in 6× sodium chloride/sodium citrate (SSC) at 45° C., followed by one or more washes in 0.2×SSC, 0.1% SDS at 50-65° C.

Gene products that are protective against DNA damage, e.g., the polypeptides encoded by the genes of Table 2, are encompassed by this application. The polypeptides also include fusion proteins which contain either the full-length polypeptide or a functional fragment thereof fused to an unrelated amino acid sequence. The unrelated sequences can be additional functional domains or signal peptides. Signal peptides are described in greater detail and exemplified below. The polypeptides can also be any of those described above but with one or more conservative substitutions. A functional fragment of a polypeptide is one that is active to prevent oxidative DNA damage in a method described herein. The polypeptide can (a) include amino acid residues 40-127 of SEQ ID NO:2 or amino acid residues 40-127 of SEQ ID NO:2 with about 10% or fewer (e.g., 10, 8, 7, 6, 5, 4, 3, 2, or 1) amino acid substitutions, e.g., conservative amino acid substitutions; and (b) include less than the full length sequence of the SEQ ID NO:2.

A protective gene product, i.e., mRNA or protein, can be produced in host cells using methods that are known to those of skill in the art. See e.g., Current Protocols in Molecular Biology, John Wiley & Sons, New York, N.Y. (2003). Total bacterial RNA can be isolated using a number of methods, including using commercially available kits from Ambion or Qiagen. Specific protective gene product mRNA can be isolated using complementary nucleic acids bound to magnetic beads or columns that selectively isolate nucleic acids on the basis of hybridization. The protein product of the expressed genes can be isolated and purified using standard methods including, but not limited to, chromatography (e.g., ion exchange, affinity, and sizing column chromatography), centrifugation, differential solubility, or by any other standard technique for the purification of proteins. See, e.g., Current Protocols in Molecular Biology Ch. 10 and sections 10.9-10.16.

Alternatively, gene products can be synthesized using in vitro methods. Chemical methods for synthesizing RNA gene products are known in the art. In some applications, it will be preferable to synthesize oligomers composed of RNA analogs of the protective mRNA gene product, e.g., to increase the stability of the protective mRNA gene product. RNA analogs include modified backbone analogs, e.g., methyl phosphonoate, methyl phosporothioate, and methyl phosphoramydate analogs, as well as modified sugar base analogues, e.g., 2'-deoxy-2'-fluoro oligoribonucleotide, 2'-deoxy-2'-amine oligoribonucleotides 2'-O-alkyl oligoribonucleotide, deoxy-2'-C-alkyl oligoribonucleotide, and 2'-C-alkyl oligoribonucleotide analogs.

In vitro methods of generating peptide analogs of protein gene products are also known in the art. Peptide analogs include peptidomimetics (e.g., peptoid oligomers, e.g., peptoid amide or ester analogues, D-peptides, β-peptides, oligourea or oligocarbamate); small peptides (e.g., tripeptides, tetrapeptides, pentapeptides, or larger); cyclic peptides; phosphorous analogs of amino acids, such as α-aminophosphonic acids and α-aminophosphinic acids.

Any of the therapeutic gene products described herein can be incorporated into a pharmaceutical composition described herein.

Application for Genes and Gene Products Protective Against Oxidative DNA Damage: Genetic Screens Nucleic acid sequences identified by the methods disclosed herein, e.g., those described in Example 11, can be used in diagnostic screens designed to determine if a subject has a higher than normal risk of oxidative DNA damage. A subject is considered to be at a higher than normal risk of oxidative DNA damage if the subject carries a mutant or truncated allele of a nucleic acid sequence whose normal allele is protective against oxidative DNA damage in *E. coli*. Such individuals are said to carry a polymorphic allele of a gene that is protective against oxidative DNA damage.

Genetic screening (also called genotyping or molecular screening), can be broadly defined as testing to determine if a patient has one or more mutations and/or polymorphisms that either cause a disease state or are "linked" to the mutation causing a disease state. Linkage refers to the phenomenon that DNA sequences that are close together on a chromosome have a tendency to be inherited together. Two sequences may be linked because of some selective advantage of co-inheritance. More typically, however, two polymorphic sequences are co-inherited because of the relative infrequency with which meiotic recombination events occur within the region between the two polymorphisms. The co-inherited polymorphic alleles are said to be in linkage disequilibrium with one another because, in a given population of subjects, they tend to either both occur together or else not occur at all in any particular member of the population. Indeed, where multiple polymorphisms in a given chromosomal region are found to be in linkage disequilibrium with one another, they define a quasi-stable genetic "haplotype." In contrast, recombination events occurring between two polymorphic loci cause them to become separated onto distinct homologous chromosomes. If meiotic recombination between two physically linked polymorphisms occurs frequently enough, the two polymorphisms will appear to segregate independently and are said to be in linkage equilibrium.

While the frequency of meiotic recombination between two markers is generally proportional to the physical distance between them on the chromosome, the occurrence of "hot spots" as well as regions of repressed chromosomal recombination can result in discrepancies between the physical and recombination distance between two markers. Thus, in certain chromosomal regions, multiple polymorphic loci spanning a broad chromosomal domain may be in linkage disequilibrium with one another, and thereby define a broad-spanning genetic haplotype. Furthermore, where a disease-causing mutation is found within or in linkage with this haplotype, one or more polymorphic alleles of the haplotype can be used as a diagnostic or prognostic indicator of the likelihood of developing the disease. This association between otherwise benign polymorphisms and a disease-causing polymorphism occurs if the disease mutation arose in the recent past, so that sufficient time has not elapsed for equilibrium to be achieved through recombination events. Therefore, identification of a human haplotype that spans or is linked to a nucleotide sequence that is protective against oxidative DNA damage serves as a predictive measure of an individual's likelihood to suffer oxidative DNA damage. Importantly, such prognostic or diagnostic procedures can be utilized without necessitating the identification and isolation of the actual disease-causing lesion. This is significant because the precise determination of the molecular defect involved in a disease process associated with oxidative DNA damage can be difficult and laborious, especially in the case of multifactorial diseases such as certain forms of cancer.

For the purposes of genetic screening, detection of a polymorphic allele associated with oxidative DNA damage can be utilized without consideration of whether the polymorphism is directly involved in the etiology of oxidative DNA damage. The correlated polymorphism may be a benign allelic variant that is linked to (i.e., in linkage disequilibrium with) a disorder-causing mutation that has occurred in the recent human evolutionary past, such that sufficient time has not elapsed for equilibrium to be achieved through recombination events in the intervening chromosomal segment.

Furthermore, where a given benign polymorphic locus is in linkage disequilibrium with an apparent oxidative DNA damage-causing polymorphic locus, still other polymorphic loci that are in linkage disequilibrium with the benign polymorphic locus are also likely to be in linkage disequilibrium with the disease-causing polymorphic locus. Thus, these other polymorphic loci will also be prognostic or diagnostic of the likelihood of having inherited the oxidative DNA damage-causing polymorphic locus. Indeed, a broad-spanning human haplotype (describing the typical pattern of co-inheritance of alleles of a set of linked polymorphic markers) can be targeted for diagnostic purposes once an association has been drawn between a particular disease or condition and a corresponding human haplotype. Thus, the determination of a subject's likelihood for developing a particular disease condition can be made by characterizing one or more oxidative DNA damage-associated polymorphic alleles (or even one or more disease-associated haplotypes) without necessarily determining or characterizing the causative genetic variation.

Linkage disequilibrium can be determined using routine methods, e.g., using the GOLD software package (Schaid et al., Am. J. Hum. Genet., 70:425-34 (2002)) and the Haplo Stats suite (Zhang, et al., Proc. Natl. Acad. Sci. U.S.A., 99:7335-9 (2002)). One example of a polymorphic marker is a single nucleotide polymorphism (SNP). A database of SNPs is publicly available from the National Center for Biotechnology Information.

1. Screens for Mutations or Polymorphisms in a Subject's Nucleic Acid

Individuals that carry a nonsense, missense, or frame-shift mutation in at least one nucleic acid sequence (i.e., in a "target nucleic acid") identified as protective against DNA damage in *E. coli* are considered to be individuals at an increased risk for oxidative DNA damage. Such individuals are said to harbor a mutant allele. Methods of detecting mutant alleles in the genetic material of a subject are known in the art.

Generally, genetic material from a subject can be obtained from a biological sample. Genomic DNA can be obtained from virtually any biological tissue sample (other than pure red blood cells), e.g., whole blood, semen, saliva, tears, urine, fecal material, sweat, buccal, skin, and hair. cDNA or mRNA can be obtained from tissue samples in which the target nucleic acid is expressed.

Amplification of a nucleic acid sequence from biological samples can be accomplished by methods known to those of skill in the art, e.g., polymerase chain reaction (PCR). See, e.g., U.S. Pat. No. 4,683,202 (which is incorporated herein by reference in its entirety), ligase chain reaction (LCR) (see Wu and Wallace, Genomics 4, 560 (1989); Landegren et al., Science, 241, 1077 (1988)), transcription amplification (Kwoh et al., Proc. Natl. Acad. Sci. USA, 86, 1173 (1989)), self-sustained sequence replication (Guatelli et al., Proc. Natl. Acad. Sci. USA, 87, 1874 (1990)), and nucleic acid based sequence amplification (NASBA). A variety of suitable procedures that can be employed to detect polymorphisms are described in further detail below.

Allele-Specific Probes

The design and use of allele-specific probes for analyzing mutations or polymorphisms is known in the art (see, e.g., Dattagupta, EP 235,726; Saiki, WO 89/11548). Allele-specific probes can be designed to hybridize differentially, e.g., to hybridize to a nucleic acid sequence from one individual, but not to a corresponding segment from another individual, based on a difference in sequences between the nucleic acid segments. Relatively stringent hybridization conditions can be utilized to cause a significant difference in hybridization intensity between alleles, and possibly to obtain a condition wherein a probe hybridizes to only one of the alleles. High stringency conditions include TMAC (tetramethylammonium chloride), SDS, EDTA, Denhart's Solution, and yeast tRNA at 52° C. Probes can be designed to hybridize to a segment of DNA such that the polymorphic site aligns with a central position of the probe.

Allele-specific probes can be used in pairs, wherein one member of the pair is perfectly complementary to a reference form of a target sequence, i.e., nucleic acid sequence that is protective against oxidative damage, and the other member of the pair is perfectly complementary to a variant of the target sequence, i.e., with diminished protective capacity against oxidative DNA damage. The use of several pairs of probes immobilized on the same support may allow simultaneous analysis of multiple polymorphisms within the same target sequence.

Tiling Arrays

Mutations or polymorphisms in a nucleic acid sequence that is protective against DNA damage can also be identified by hybridization to nucleic acid arrays (see, e.g., WO 95/11995). DNA (or other nucleotide) chips can be used in allele-specific oligonucleotide hybridization methods to identify different mutant alleles by the ability of a subject's nucleic acid sequence (e.g., in a PCR amplified fragment) to bind a complementary nucleotide sequences at a known location on an addressable nucleotide array.

WO 95/11995 also describes subarrays that are optimized for the detection of variant forms of a precharacterized polymorphism. Such a subarray contains probes designed to be complementary to a second reference sequence, which is an allelic variant of the first reference sequence. The second group of probes is designed to exhibit complementarity to the second reference sequence. The inclusion of a second group (or further groups) can be particularly useful for analyzing short subsequences of the primary reference sequence in which multiple mutations are expected to occur within a short distance commensurate with the length of the probes (e.g., two or more mutations within 9 to 21 bases).

Allele-Specific Primers

An allele-specific primer hybridizes to a site on target DNA overlapping a polymorphism and only allows amplification of an allelic form to which the primer exhibits perfect complementarily. See, e.g., Gibbs, Nucleic Acid Res. 17, 2427-2448 (1989). Such a primer can be used in conjunction with a second primer that hybridizes at a distal site. Amplification proceeds from the two primers leading to a detectable product signifying the particular allelic form is present. A control is usually performed with a second pair of primers, one of which shows a single base mismatch at the polymorphic site and the other of which exhibits perfect complementarily to a distal site. The single-base mismatch prevents amplification and no detectable product is formed. The method can be optimized by including the mismatch in the 3'-most position of the oligonucleotide aligned with the polymorphism because this position is most destabilizing to elongation from the primer (see, e.g., WO 93/22456).

Direct-Sequencing

Direct analysis of the nucleotide sequence of mutations or polymorphisms can be accomplished using, e.g., the dideoxy chain termination method or the Maxam Gilbert method (see Sambrook et al. Molecular Cloning: A Laboratory Manual, 3d ed., 2001, Cold Spring Harbor, which is hereby incorporated in its entirety; Zyskind et al., Recombinant DNA Laboratory Manual, (Acad. Press, 1988)). Typically, the target nucleic acid sequence from a subject is amplified and subjected to direct sequencing protocol to determine if the subject harbors a mutant allele, or polymorphism, that renders the subject at increased risk of oxidative DNA damage.

Single Base Extension

Polymorphisms described herein can be sequenced using single base extension (SBE), a dideoxy chain termination sequencing procedure in which only the polymorphic site is sequenced, followed by fluorescence polarization (FP) analysis (e.g., using the ACYCLOPRIME™-FP SNP Detection System, Perkin-Elmer). This assay is based on the principle that incorporation of a fluorescent terminator into a primer oligonucleotide increases its polarization (see, e.g., Hsu et al. (2001) Biotechniques 31:560-570). A nucleotide at a polymorphic site can be determined by using different fluorescent terminators in the SBE reactions. For example, a target nucleic acid sequence from a subject can be PCR amplified in 96-well plates using primers. After alkaline phosphatase treatment to inactivate unincorporated dNTPs and primers, PCR products can undergo SBE using a primer described herein and fluorescent terminators. Fluorescence polarization can be determined using, e.g., a Wallac VICTOR²™ Multi-label Plate Reader (Perkin-Elmer).

Denaturing High-Performance Liquid Chromatography (DHPLC)

Denaturing high-performance liquid chromatography (DHPLC) provides another method of screening for the presence of mutant or polymorphic sequences. A subject's DNA sequence is mixed with reference nucleic acid sequence. The two samples are denatured and reannealed. If a subject's DNA sequence differs from the reference sample, both heteroduplices and homoduplices are formed. Since heteroduplices and homoduplices exhibit differential retention times during reversed phase chromatography procedures, the presence of even a single base pair mutation can be assessed using this system. See e.g., Xiao and Oefner, Human Mutation, 17:439-474 (2001).

Denaturing Gradient Gel Electrophoresis

Denaturing gradient gel electrophoresis also involves mixing a subject's nucleic acid sequence sample and a reference nucleic acid sequence sample. The two samples are denatured, and the resulting mixture of four sequence strands is allowed to reanneal. A difference in sequence between the two samples is identified based on the sequence-dependent melting properties and electrophoretic migration of DNA in solution. See e.g., Erlich, ed., PCR Technology, Principles and Applications for DNA Amplification, (W. H. Freeman and Co, New York, 1992), Chapter 7. If the subject's strand contains even a single base-pair mutation the resulting heteroduplex will have a different (lower) melting temperature $T_m$ than reference sequence homoduplex. Dissociation of the heteroduplex at the lower $T_m$ can be detected as a decrease in electrophoretic mobility at the lower temperature, which is not observed for the reference homoduplex.

Heteroduplex analysis involves the denaturation and reannealing of a mixture of wild-type and mutant DNA molecules. In nondenaturing polyacrylamide gels, homoduplices and heteroduplices exhibit distinct electrophoretic mobilities.

Single-Strand Conformation Polymorphism Analysis

Alleles of target sequences can be differentiated using single-strand conformation polymorphism analysis, which identifies base differences by alteration in electrophoretic migration of single stranded PCR products (optimally between ~150-200 bases) as described in Orita et al., Proc. Natl. Acad. Sci. USA 86:2766-2770 (1989). Amplified PCR products can be generated as described above, and heated or otherwise denatured, to form single stranded amplification products. Single-stranded nucleic acids may refold or form secondary structures that are partially dependent on the base sequence. Using non-denaturing capillary or gel electrophoresis, mutations that destroy such secondary structures can be detected as having differential electrophoretic mobility.

Enzymatic Cleavage Analysis

RNase A enzymatic cleavage can be used, under defined conditions, to cleave mismatches within RNA:RNA or RNA: DNA heteroduplices, whereupon labeled cleavage fragments are analyzed by denaturing gel electrophoresis.

Still other methods of detecting a mutation involve differential susceptibility of homoduplices and heteroduplices to chemical or enzymatic cleavage. For example, mispaired nucleotides within heteroduplices are modified by chemical agents using Maxam-Gilbert sequencing chemistry. Hydroxylamine reacts with mispaired cytosine residues, and osmium tetroxide cleaves mispaired thymine residues. Fragments of heteroduplices are compared to the fragments of known homoduplices.

Fluorescent assisted mismatch analysis is another method of detecting mutations in heteroduplexes. See Verpy et al., Proc Nat'l Acad. Sci. USA, 91:1873-77(1994). In this method a reference nucleic acid sample and a nucleic acid sample from a subject are each fluorescently end-labeled with strand-specific labels. The two samples are mixed, denatured and reannealed to each other. Heteroduplexes are subjected to cleavage reaction, e.g., chemical cleavage, and then analyzed by denaturing gel electrophoresis. Since each strand is differentially labeled, heteroduplex cleavage products have two signals, one cleavage product with a mutant sense strand and another mutant product with a differently labeled antisense strand.

mRNA Expression Profiling

A subject that expresses insufficient quantity of a nucleic acid sequence, e.g., mRNA that is protective against oxidative can be considered to be at an increased risk for oxidative DNA damage. The level of mRNA in a biological sample can be evaluated using nucleic acid amplification, e.g., by RT-PCR (Mullis, U.S. Pat. No. 4,683,202), ligase chain reaction (Barany (1991) Proc. Natl. Acad. Sci. USA, 88:189-193), self sustained sequence replication (Guatelli et al. (1990) Proc. Natl. Acad. Sci. USA, 87:1874-1878), transcriptional amplification system (Kwoh et al. (1989) Proc. Natl. Acad. Sci. USA, 86:1173-1177), Q-Beta Replicase (Lizardi et al. (1988) Bio/Technology, 6:1197), rolling circle replication (Lizardi et al., U.S. Pat. No. 5,854,033), or any other nucleic acid amplification method, followed by the detection of the amplified molecules using techniques known in the art.

The level of mRNA in a biological sample can be detected by in situ methods, for example, a cell or tissue sample can be prepared/processed and immobilized on a support, typically a glass slide, and then contacted with a probe that can hybridize to an mRNA target sequence. The level of multiple mRNA transcripts can be detected, e.g., by serial analysis of gene expression. See, e.g., U.S. Pat. No. 5,695,937.

Aberrant mRNAs can be detected using a truncation assay system that identifies nonsense mutant transcripts by amplifying using PCR (at least) a segment of a gene encoding a protein. The segment is then transcribed and translated in vitro, and the protein generated is analyzed by gel electrophoresis. A smaller protein band than expected indicates the presence of a mutation encoding a truncated polypeptide.

2. Detecting Mutant Proteins Associated with Oxidative DNA Damage

Typically, a protein encoded by a gene that is protective against oxidative DNA damage can be detected using methods that include contacting an agent that selectively binds to the protein, such as an antibody, with a sample to evaluate the level of protein in the sample. In some embodiments, the antibody bears a detectable label. These methods can be used to detect a reduction in, or the absence of, normal protein expression in a sample. These methods can also be used to detect whether a mutant protein (e.g., one that does not effectively bind the protein binding agent) is expressed in a sample. If a subject displays a reduced or absent expression of a normal protein encoded by a nucleic acid that is protective against oxidative DNA damage in $E.$ $coli$, then the subject is considered to have an increased risk of oxidative DNA damage.

In vitro techniques for detection of a protein include enzyme linked immunosorbent assays (ELISAs), immunoprecipitations, immunofluorescence, enzyme immunoassay (EIA), radioimmunoassay (RIA), and western blot analysis. In vivo techniques for detection of protein include introducing into a subject a labeled antibody, e.g., labeled with a radioactive marker whose presence and location in a subject can be detected by standard imaging techniques.

Some protein assays use one antibody specific for the N-terminal portion of the protein and a second antibody specific for the C-terminal portion of the protein. If a given sample is from a subject who does not have a truncated gene product, the amount of protein detected by both assays will be comparable. If the sample is from an individual who does have a truncated gene product, then the amount of protein measured using the antibody specific for the N-terminal portion of the protein will be higher than that measured using the antibody specific for the C-terminal portion of the protein.

Applications for Genes, Gene Products, and Compounds Protective Against Oxidative DNA Damage: Pharmaceutical Compositions The compounds, nucleic acids, and polypeptides encoded by the nucleic acids (all of which are referred to herein as "DNA protective agents"), can be incorporated into pharmaceutical compositions. Such compositions typically include the DNA protective agent formulated with a pharmaceutically acceptable carrier. A "pharmaceutically acceptable carrier" can include one or more of: solvents, dispersion media, coatings, antibacterial and antifungal agents, isotonic and absorption delaying agents, and the like, compatible with pharmaceutical administration. Supplementary DNA protective agents can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, CREMOPHOR™ EL (BASF, Parsippany, N.J.) or phosphate buffered saline (PBS). In all cases, the composition is preferably sterile and fluid to the extent that easy syringability exists. It is preferably stable under the conditions of manufacture and storage and may be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. A desired fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol, sorbitol, sodium chloride in the composition. Prolonged absorption of the injectable compositions can be achieved by including an agent that delays absorption, e.g., aluminum monostearate and gelatin, in the composition.

Sterile injectable solutions can be prepared by incorporating the DNA protective agent in the required amount in an appropriate solvent with one or a combination of ingredients enumerated above, followed by filtered sterilization. Typically, dispersions are prepared by incorporating the DNA protective agent into a sterile vehicle which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the DNA protective agent can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds can be delivered in the form of an aerosol spray from a pressured container or dispenser that contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the DNA protective agents are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the DNA protective agents are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is advantageous to formulate oral or parenteral compositions in dosage unit form for ease of administration and uniformity of dosage. Dosage unit form as used herein refers to physically discrete units suited as unitary dosages for the subject to be treated, each unit containing a predetermined quantity of DNA protective agent calculated to produce the desired therapeutic effect in association with the required pharmaceutical carrier.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index, which can be expressed as the ratio LD50/ED50. Compounds which exhibit high therapeutic indices are preferred. Whereas compounds that exhibit toxic side effects may be used, it is preferable to utilize a delivery system that targets such compounds to the site of affected tissue in order to minimize potential damage to uninfected cells and, thereby, reduce side effects.

The data obtained from cell culture assays and animal studies can be used in formulating a range of dosage for use in humans. The dosage of such compounds lies preferably within a range of circulating concentrations that include the ED50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

For the compounds described herein, an effective amount, e.g., of a protein or polypeptide (i.e., an effective dosage), ranges from about 0.001 to 30 mg/kg body weight, e.g., about 0.01 to 25 mg/kg body weight, e.g., about 0.1 to 20 mg/kg body weight. The skilled artisan will appreciate that certain factors influence the dosage and timing required to effectively treat a patient, including, but not limited to, the type of patient to be treated, the severity of the disease or disorder, previous treatments, the general health and/or age of the patient, and other diseases present. Moreover, treatment of a patient with a therapeutically effective amount of a protein, polypeptide, antibody, or other compound can include a single treatment or, preferably, can include a series of treatments.

For antibodies, a useful dosage is typically 0.1-20 mg/kg of body weight (e.g., 0.1-5 mg/kg, 5-20 mg/kg, 1-10 mg/kg, or 1-5 mg/kg of body weight). Typically, partially human antibodies and fully human antibodies have a longer half-life within the human body than other antibodies. Accordingly, lower dosages and less frequent administration are possible. Modifications such as lipidation can be used to stabilize antibodies and to enhance uptake and tissue penetration. A method for lipidation of antibodies is described by Cruikshank et al., J. Acquired Immune Deficiency Syndromes and Human Retrovirology, 14:193(1997).

If the compound is a small molecule, exemplary doses can include milligram or microgram amounts of the small molecule per kilogram of subject or sample weight (e.g., about 1 microgram per kilogram to about 500 milligrams per kilogram, about 100 micrograms per kilogram to about 5 milligrams per kilogram, or about 1 microgram per kilogram to about 50 micrograms per kilogram. It is furthermore understood that appropriate doses of a small molecule depend upon the potency of the small molecule with respect to the expression or activity to be modulated. When one or more of these small molecules is to be administered to an animal (e.g., a human) to modulate expression or activity of a polypeptide or nucleic acid of the invention, a physician, veterinarian, or researcher may, for example, prescribe a relatively low dose at first, subsequently increasing the dose until an appropriate response is obtained. In addition, it is understood that the specific dose level for any particular animal subject will depend upon a variety of factors including the activity of the specific compound employed, the age, body weight, general health, gender, and diet of the subject, the time of administration, the route of administration, the rate of excretion, any drug combination, and the degree of expression or activity to be modulated.

Nucleic acid molecules that are protective against oxidative DNA damage can be inserted into vectors and used as gene therapy vectors or delivered as naked DNA, e.g., with a "gene gun." Gene therapy vectors can be delivered to a subject by, for example, intravenous injection, local administration (see, e.g., U.S. Pat. No. 5,328,470) or by stereotactic injection (see, e.g., Chen et al. (1994) *Proc. Natl. Acad. Sci. USA*, 91:3054-3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells that produce the gene delivery system.

A pharmaceutical composition that includes a DNA protective agent can be formulated in a cosmetic product, e.g., a sunscreen, a sun tan lotion, or another skin or hair care product. Such cosmetic products can be applied to the skin of a subject to prevent oxidative DNA damage caused by exposure to the sun or other environmental factors. In some embodiments, a sunscreen or sun tan lotion containing a DNA protective agent can be used to protect a subject's skin against oxidative DNA damage associated with ultraviolet irradiation, e.g., from the sun. The protective agent can also be administered with one or more permeabilizing agents such as DMSO.

The pharmaceutical compositions can be included in a container, pack, or dispenser together with instructions for administration.

Testing of Protective Agents in Animal Models of Oxidative DNA Damage

In some cases, it will be advantageous to test a DNA protective agent in an animal model of oxidative DNA damage. Such animal models include mutant or transgenic animals that are deficient in a pathway that prevents oxidative damage, or repairs oxidative DNA damage. Examples of DNA repair mutant animals include Nth, OGG1, and Mth knockout mice, as well as the Mth OGG1 double mutant mouse (Takao et al., EMBO J., 21:3486-93 (2002); Tsuzuki et al., Proc. Natl. Acad. Sci. USA, 98:11456-61 (2001); and Sakumi et al., Cancer Res., 63:902-5 (2003)). DNA protective agents can also be administered to animal models of diseases associated with oxidative DNA damage, e.g., animal models of Alzheimer's disease, diabetes, Parkinson's disease, Huntington's disease, heart disease, and cancer.

The invention is further described in the following examples, which do not limit the scope of the invention described in the claims.

EXAMPLES

Example 1

Suppression of the *E. coli* Oxidative Mutator Phenotype

The lacZ mutant *E. coli* strain cc104 and its isogenic derivatives MV4705 (cc104 Δfpg::Tn10), MV4707 (cc104 ΔmutY::Catr) and MV4709 (cc104 Δfpg::Tn10 ΔmutY::Catr) were constructed by P1 transduction, selecting for the appropriate antibiotic resistance marker.

Papillation assay medium (Michaels, et al., Nucl. Acids Res., 19:3629-3632 (1991)) contains 0.2% D-glucose, 1× A salts, 1 mM $MgSO_4$, 5 mg/ml thiamine hydrochloride, 0.5 mM IPTG, 40 mg/ml X-Gal, 0.5 mg/ml P-Gal, 50 mg/ml carbenicillin and 2% agar. For pBAD24 induction, 0.2% L-arabinose (Guzman, et al., J. Bacteriol., 177:4121-30 (1995)) was added and the glucose concentration was reduced to 0.05%. Papillation was scored 5-6 days after plating. Spontaneous mutation frequencies (revertants/total cells) were quantitated by plating dilutions of the overnight cultures of individual transformants on lactose and glucose minimal medium, incubating 3 days at 37° C. LacZ revertants are detected on lactose plates, total colonies on glucose plates.

To overexpress the *E. coli* Fpg protein, a 1 kbp EcoRI/HindIII fragment from V243 (Michaels, et al., Nucl. Acids Res., 19:3629-3632 (1991)) was subcloned into pTrc99A (Pharmacia, Inc.) (pTrc-Fpg). To overexpress OGG1, pTrc-hOGG1 was constructed by subcloning a 5.7 kbp XbaI/HindIII fragment from pET8c-OGG1-1a (Nishioka, et al., Mol. Biol. Cell, 10:1637-52 (1999)) into pTrc99A. To overexpress human MutY, pTrc-hMYH was constructed by subcloning a 4.5 kbp StuI/BamHI fragment from pT7blue-hMYHα3-2 (Ohtsubo, et al. Nucleic Acids Res., 28:1355-64 (2000)) into SmaI/BamHI linearized pTrc99A.

The fpg mutY lacZcc104 strain (MV4709) of *E. coli* was used to screen for human cDNAs that express proteins protective against spontaneous DNA oxidation. This *E. coli* strain is a spontaneous mutator because it lacks Fpg and MutY (Michaels, et al., Proc. Nat'l. Acad. Sci. USA, 89:7022-7025 (1992)). Fpg repairs 8-oxoG, the predominant oxidative DNA lesion, and MutY removes A mispaired with 8-oxoG; a high frequency mispairing event during replication of template 8-oxoG lesions resulting in GC→TA transversion mutations.

Production of reactive oxygen species (ROS) by normal metabolic processes leads to accumulation of 8-oxoG lesions in DNA and results in elevated spontaneous mutagenesis. The GC→TA transversions are detected using the cc104 allele of lacZ, which reverts only by GC→TA transversion. On indicator medium, *E. coli* cells carrying lacZ(cc104) produce distinctive white lacZ⁻ colonies containing dark blue lacZ⁺ revertant microcolonies, or papillae (FIGS. 1A-F). FIGS. 1A and 1B compare the mutator phenotype of the fpg mutY double mutant strain (FIG. 1B) with that of wild type *E. coli* (FIG. 1A) and show the suppression of mutagenesis resulting from the expression of *E. coli* and human DNA repair genes. Complete suppression of the fpg mutY strains mutator phenotype is seen upon high level expression of the bacterial fpg gene (FIG. 1C), reducing the frequency of transversions to levels below that seen in wild type (FIG. 1A). Since most of the transversion mutations seen in the wild type strain can also be prevented by fpg overexpression, GC→TA transversions can be considered a signature of oxidative DNA damage. Suppression of the fpg mutY mutator phenotype is also seen upon expression of the human 8-oxoG glycosylase, OGG1 (FIG. 1D), or the human MutY ortholog, MYH (FIG. 1E)

Example 2

Isolation of the Human PC4 Gene

Plasmids carrying the full-length coding sequences of the wild-type (PC4-wt) or ssDNA-binding defective mutants (PC4-W89A and PC4-β2β3) are described in Werten, et al., EMBO J., 17:5103-11 (1998). The full-length PC4 wild type and mutant protein coding sequences were isolated as NdeI and EcoRI fragments and subcloned into the corresponding sites in pET-28b(+) to attach the 6× histidine tag to their amino termini. The insert containing NcoI and SalI fragments from the pET-28(+) derivatives were subcloned into the corresponding sites of pBAD24 for araBAD promoter-dependent expression. Expression of the 6× his-tagged PC4 proteins was verified by western blotting using the anti-Penta His antibody (Qiagen).

The PC4 gene was isolated by transforming the E. coli fpg mutY lacZcc104 strain MV4709 with a human cDNA library constructed in a bacterial expression vector (Perkins et al., Proc. Nat'l. Acad. Sci. USA, 96:2204-2209 (1999) and Volkert, Proc. Nat'l. Acad. Sci. USA, 97:14530-14535(2000)), then screening individual transformed colonies for suppression of the spontaneous mutator phenotype. FIG. 1F shows that the PC4 expression plasmid strongly suppressed the mutator phenotype of a cc104 fpg mutY strain, indicated by the presence of very few visible blue papillae. Expression of PC4 provides complete mutation suppression under these conditions, as confirmed by a quantitative mutagenesis assay (Table 2).

TABLE 2

Mutation frequency of fpg mutY strains expressing bacterial and human DNA repair genes

| Strain | Genotype | Plasmid | Mutation Frequency (mutants/10$^8$ Cells)$^a$ |
|---|---|---|---|
| MV4724 | Wild Type | pTrc99A vector | 3 |
| MV4755 | fpg mutY | pTrc99A vector | 2750 |
| MV4763 | fpg mutY | pTrc99A-fpg | 0 |
| MV4761 | fpg mutY | pTrc99A-hOGG1 | 11 |
| MV4762 | fpg mutY | pTrc99A-hMYH | 58 |
| MV4722 | fpg mutY | pS380$^b$-PC4 | 0 |

$^a$Representative data are shown.
$^b$pSE380 is identical to pTrc99A except for the presence of additional cloning sites in the vector.

Table 2 shows the mutation frequency of wild type and mutator strains of E. coli with a control vector (pTrc99A) or vectors that contain protective sequences (pTrc99A with fpg, hOGG1, hMYH, or PC4). Whereas wild-type E. coli has a mutation rate in this assay of 3/10$^8$ cells, the mutator strain (with fpg and mutY inactivated) has a nearly 1000-fold higher mutation rate. Transformation with a vector containing hMYH reduces the mutation rate approximately 50-fold, whereas transformation with a vector containing fpg, hOGG1, or PC4 restores the mutation rate to near wild type levels.

PC4 is a transcription cofactor mediating activator-dependent transcription by RNA polymerase II through interactions with sequence-specific activators and TFIIA of the basal transcription machinery (Ge et al., Cell, 78:513-23 (1994) and Kretzschmar et al., Cell, 78:525-34 (1994)). PC4 encodes a polypeptide of 127 amino acids (a.a.) (FIG. 2). Functional deletion analyses revealed a bipartite structure of PC4 comprising an amino-terminal regulatory domain (amino acid residues 1-62) and a carboxyl-terminal, single stranded DNA (ssDNA) binding/dimerization domain (CTD; amino acid residues 63-127) (Brandsen et al., Nat. Struc. Biol., 4:900-3 (1998); Kaiser et al., EMBO J., 14:3520-7 (1994); Werten et al., J. Mol. Biol., 276:367-77 (1998); Werten et al., EMBO J., 17:5103-11 (1998)). The X-ray crystal structure of the PC4-CTD shows that it forms a dimer with two ssDNA binding channels running in opposite directions. Previously, in vitro transcription studies showed that a peptide comprised of amino acid residues 22-87 of PC4 is necessary and sufficient for co-activation, and that the lysine rich motif between amino acid residues 22 and 41 is required for transcription activation (Holloway et al., J. Biol. Chem., 275:21668-77 (2000)). It has also been demonstrated that inactivation of the ssDNA binding activity of PC4 does not affect its ability to function in transcription activation.

Example 3 ssDNA Binding and Dimerization Motifs Alone are Sufficient for PC4 to Function as an Oxidative Antimutator Protein in E. coli The PC4 cDNA clone isolated in this study was truncated at its 5' end, lacking the codons for the first 39 amino acid residues, but containing a short heterologous DNA sequence of unknown origin encoding MPSNSAPAHGTSS (SEQ ID NO:3) fused to glutamine 40 of PC4. The N-terminal truncation of PC4 removes the lysine rich motif required for coactivation, but leaves intact the ssDNA binding and dimerization domains. This suggests that the ssDNA binding and dimerization motifs alone are sufficient for PC4 to function as an oxidative antimutator protein in E. coli.

Figure 3A:
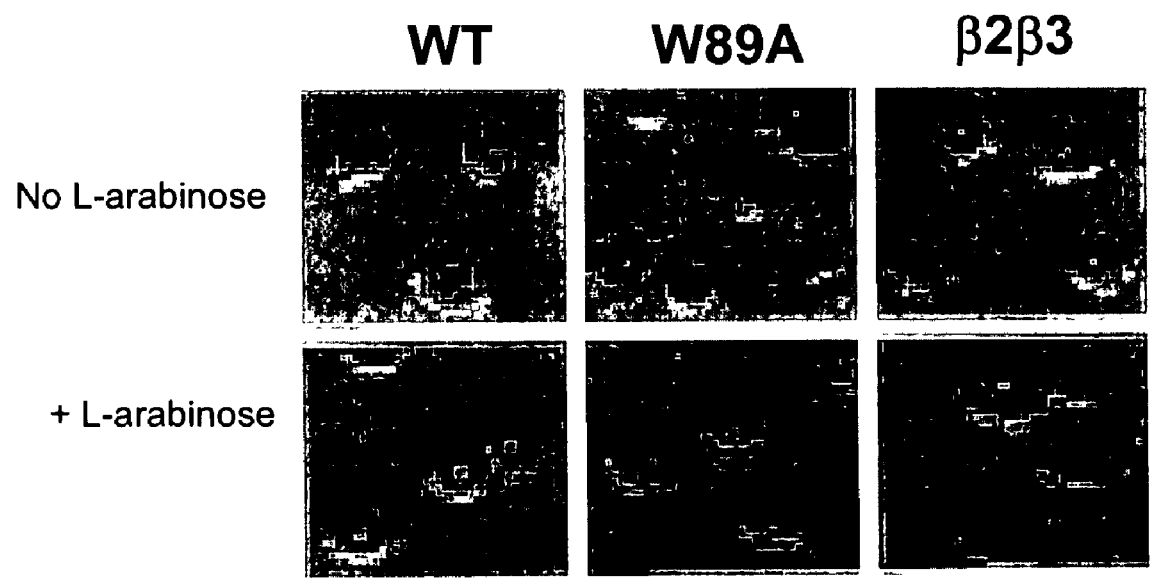
FIG. 3A is a series of images showing that single-strand DNA binding activity of PC4 is required for mutation suppression in *E. coli* fpg mutY. Histidine tagged forms of PC4 and its ssDNA binding defective mutants W89A and β2β3 are expressed from the L-arabinose inducible araBAD promoter present on the pBAD24 vector. The upper panels show the mutator activity of *E. coli* fpg mutY in the absence of L-arabinose, lower panels show the mutator activity of wild-type and mutant forms of PC4 after induction by L-arabinose.

To test whether ssDNA binding and dimerization motifs alone are sufficient for PC4 to function as an oxidative antimutator protein in E. coli., we obtained the cloned full length wild type PC4 gene, transferred it into the L-arabinose inducible pBAD24 bacterial expression vector (Guzman et al., J. Bacteriol., 177:4121-30 (1995)), and tested its ability to function as an antimutator. FIG. 3A shows that wild type PC4 is able to fully suppress the mutator phenotype of the E. coli fpg mutY strain, indicating that the full length and truncated fusion forms of PC4 isolated in this study have similar antimutator function.

Figure 3B:
FIG. 3B is an image of a western blot using anti-histidine antibody to determine levels of wild type and mutant protein expression in the strains depicted of FIG. 3A. Lanes are marked to indicate the protein extracts from *E. coli* grown in the presence (+) or absence (−) of arabinose; the right-hand section shows the same gel stained with Coomassie brilliant blue.

Example 4 ssDNA Binding Activity of PC4 is Required for Suppression of Oxidative Mutagenesis Since the PC4 clone we originally isolated contained only the ssDNA binding and dimerization domains of PC4, we tested if ssDNA binding activity is required for the antimutator activity in the fpg mutY strain of E. coli by comparing two ssDNA binding deficient mutants of PC4 constructed by Werten et al. (Werten et al., J. Mol. Biol., 276:367-77 (1998)) with the full length, wild type PC4. In the absence of L-arabinose, no protein expression was detectable by western blot (FIG. 3B, left panel) and no mutation suppression was detected (FIG. 3A, upper panels). In the presence of inducer, all forms of PC4 were expressed equally well (FIG. 3B). However, compared to wild type PC4, the ssDNA binding deficient mutants were severely impaired in their ability to suppress the oxidative mutator phenotype when expressed in the fpg mutY strain (FIG. 3A), demonstrating that the ssDNA binding activity is required for the antimutator function of PC4 in the bacterial assay.

Example 5

Yeast sub1Δ Mutants are Hypersensitive to Hydrogen Peroxide Construction of Yeast Mutant Strains The *Saccharomyces cerevisiae* wild-type strain FY833 (MATa his3Δ200 leu2Δ1 lys2Δ202 trp1Δ63 ura3-52) and the sub1Δ mutant strain YMH476 (FY833 sub1Δ::hisG) are described in Wu et al., Genetics, 153:643-52 (1999). Additional sub1Δ mutants were constructed by PCR-mediated one-step gene replacement methods (Brachmann et al., Yeast 14:115-32(1998)). Cells were cultured either in YPD (1% yeast extract, 2% peptone, 2% dextrose) or, for plasmid bearing strains, in synthetic complete medium lacking leucine or uracil (SC-leu or SC-ura). To express PC4 in yeast strains, the coding sequence for amino acids 40-127 was amplified by PCR using the PC4 cDNA clone initially isolated from the genetic screen as the template with primers PC4-N (acgcgtcgacATGcaaaagacaggtgagacttcgagagctctg (SEQ ID NO:4)) and PC4-C (ccgctcgagtcatcttacaaattcctctgc (SEQ ID NO:5)). The ATG initiation codon shown in upper case letters along with the italicized sequences for SalI and XhoI restriction sites were added for protein expression and cloning purposes. The SalI and XhoI treated PCR product was inserted into pMV611, which carries the LEU2 gene from pRS315 (Sikorski and Hieter, Genetics, 122:19-27 (1989)) and the GPD promoter from p426-GPD (Mumberg et al., Gene, 156:119-122 (1995)).

To express the Sub1 protein, the SUB1 ORF was amplified from the FY833 genomic DNA by PCR using primers X001-SUB1f (gctctagatgtcatattacaacaggtatagg (SEQ ID NO:6)) and E292-SUB1r (gcgaattcttattcttcttcacttatgtcg (SEQ ID NO:7)). The italicized sequences for XbaI and EcoRI restriction sites were introduced to the ends of the PCR product for cloning into p416-GPD, which carries the URA3 gene for selection. MVY219 (rad2Δ::TRP1) and MVY221 (sub1Δ rad2Δ::TRP1) RAD2 deletion strains were constructed by transforming FY833 (wt) and YMH476 (sub1Δ) with SalI-digested pWS521 (Reed et al., J. Biol. Chem., 45:29481-8 (1998)).

$H_2O_2$ Sensitivity and Induced Mutagenesis

Yeast strains were grown to mid-log phase at 30° C., washed and resuspended in PBS. Cells were then treated with $H_2O_2$ by shaking at 30° C. for 1 hour as indicated. Cells were harvested by centrifugation, washed and resuspended in sterile deionized water, diluted and plated on YPD for survival analysis of non plasmid bearing strains, or SC-leu or SC-ura for plasmid bearing strains. Representative data are shown to measure the can1$^r$ mutagenesis, cells were plated on synthetic medium lacking arginine but containing 60 μg/ml canavanine and incubated at 30° C. for 3-4 days for survival and 4-5 for mutagenesis.

UV and MMS Sensitivity Tests

Yeast strains were grown to mid-exponential phase at 30° C., washed with water, suspended in PBS and incubated with the indicated concentrations of Methyl methanesulfonate (MMS; Sigma Chemical) for 1 hour at 30° C., diluted and plated on YPD plates. Surviving colonies were counted after 3 to 4 days incubation at 30° C. For UV dose response tests, approximately 1000 exponential phase cells were placed in each spot on YPD plates. Spots were irradiated with UV (λ=254 nm), in 30 J/m² increments using a Stratalinker UV crosslinker (Stratagene). Plates were then incubated in the dark at 30° C. for 3-4 days.

To determine if PC4 functions to prevent oxidative mutagenesis in eukaryotes, we utilized yeast genetics. Sequence analysis reveals that PC4 orthologs exist in all sequenced eukaryotic genomes and that the most conserved region is the C-terminal ssDNA binding and dimerization domains. The *S. cerevisiae* PC4 ortholog, termed Sub1 or Tsp1p, shows 48% identity and 58% similarity when compared with the C-terminal region (amino acid residues 63-127) of PC4. Like its human ortholog, Sub1 is involved in various aspects of transcription, but is not essential for viability.

Figure 4A:
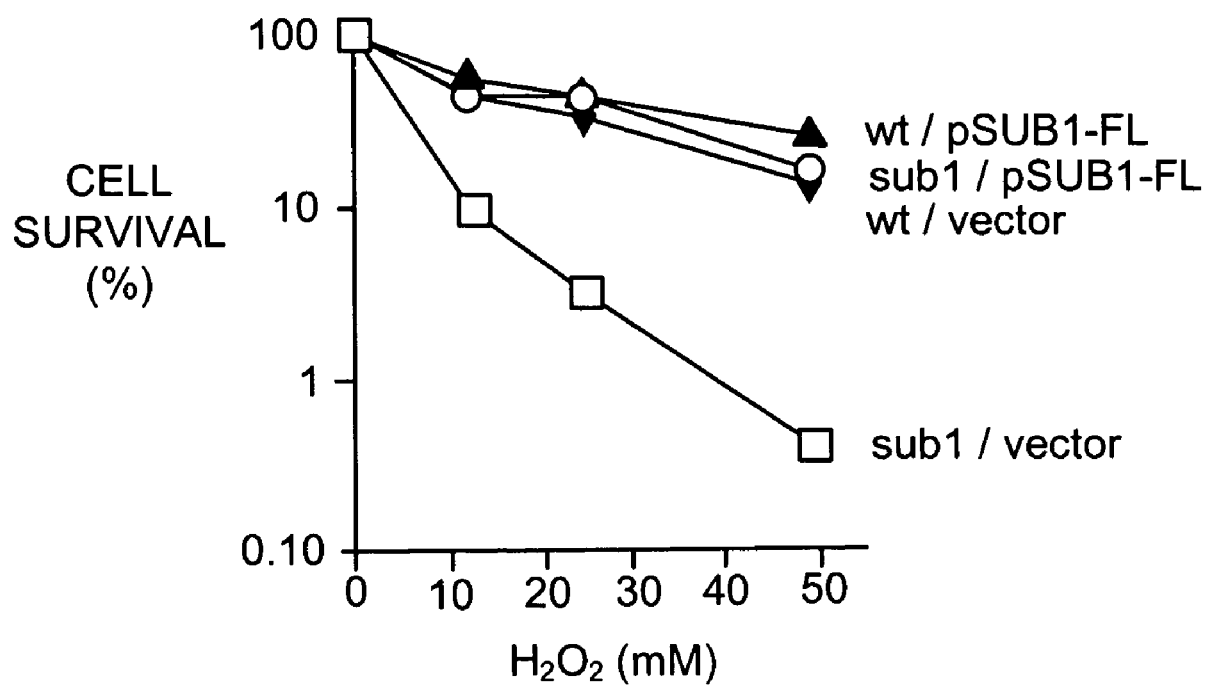
FIG. 4A is a graph showing the peroxide sensitivity (as a function of cell survival) of yeast sub1Δ mutant strain and its suppression by yeast SUB1. Wild-type yeast carrying the vector p416-GPD is indicated (♦); *S. cerevisiae* sub1Δ mutant carrying the vector p416-GPD is indicated (□); wild-type carrying the full length SUB1 gene is indicated (▲); and *S. cerevisiae* sub1Δ mutant carrying the full length SUB1 gene expression plasmid is indicated (○).
Figure 5A:
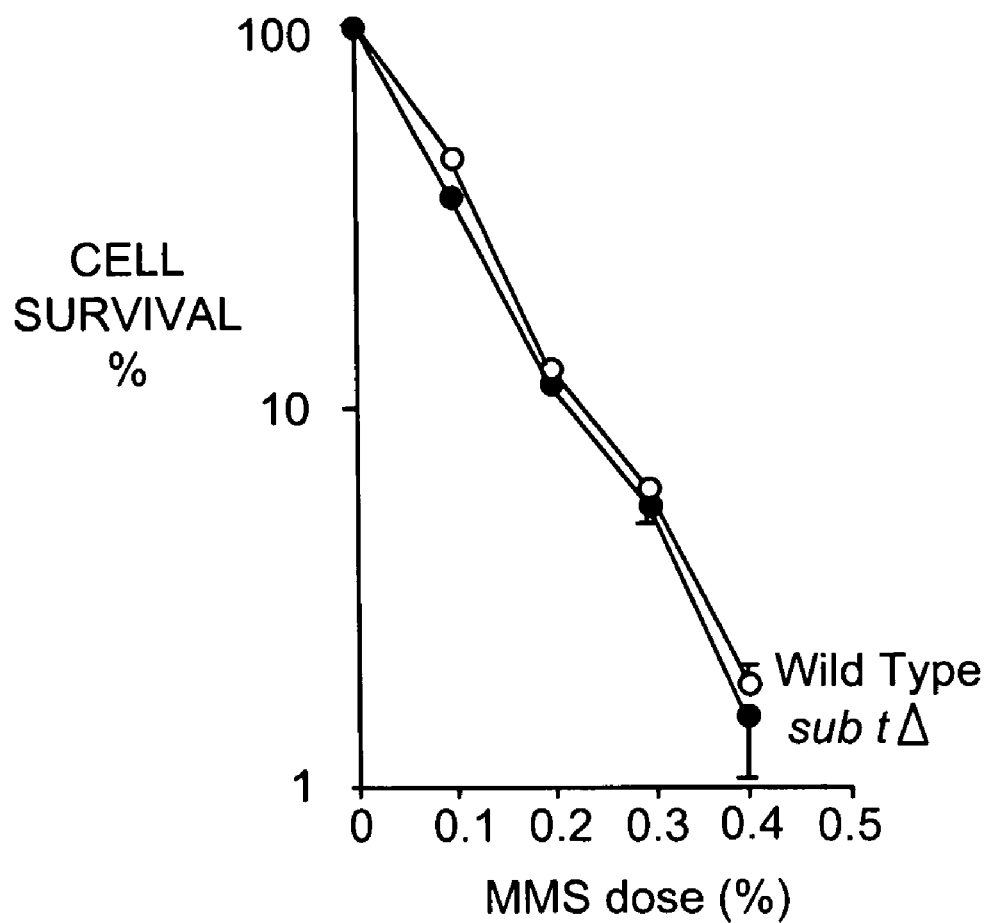
FIG. 5A is a graph showing the averaged data of three experiments in which wild type yeast (♦) and a sub1Δ mutant (○) were exposed to increasing doses of MMS. Error bars indicate standard error of the mean and are shown when they extend beyond the symbol.
Figure 5B:
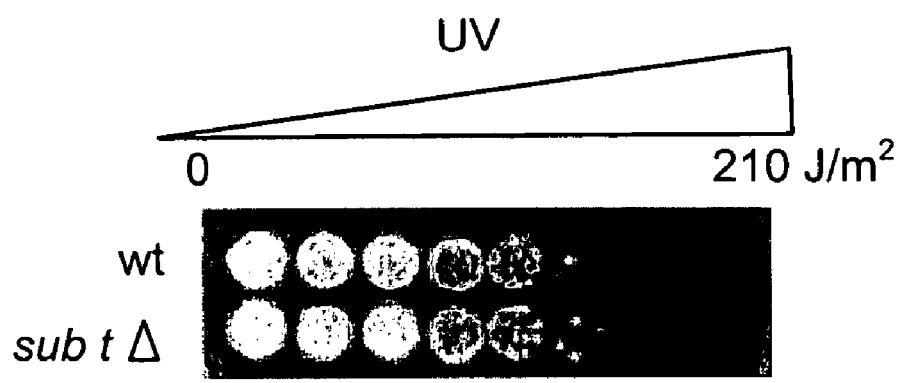
FIG. 5B is an image of yeast spots exposed to increasing doses of UV radiation. Overnight cultures were diluted to inoculate each spot with approximately 1000 cells of wild type (upper row) and sub1Δ mutant (lower row) on YPD agar plates and exposed to increasing doses of UV as indicated by the graphic above the yeast spots.

To determine if Sub1 plays a role in oxidation protection, we tested yeast sub1Δ mutants for phenotypes associated with oxidative stress, DNA damage, or repair. FIG. 4A shows that the yeast sub1Δ mutant (Wu et al., Genetics, 153:643-52 (1999)) is extremely hyper-sensitive to hydrogen peroxide compared to its wild-type parent. To confirm this, we disrupted the SUB1 gene in two other laboratory strains, W303-1B (lab strain) and RDKY3023 (Chen and Kolodner, Nat. Genet., 23:81-5 (1999), and found similar degrees of sensitization. Reintroduction of the wild type SUB1 gene on the p416-GPD yeast expression vector fully restores peroxide resistance to the sub1Δ mutant, demonstrating that the observed peroxide sensitivity is solely due to the sub1Δ mutation (FIG. 4A). In contrast, the sub1Δ mutant strain does not cause increased sensitivity to methylation or UV treatments (FIG. 5), suggesting that Sub1 does not play a role in either NER or BER of alkylation damage, but rather is specific for protection from oxidative DNA damage.

Example 6 hPC4 can Suppress the Peroxide Sensitivity of the Yeast sub1Δ Mutant

Figure 4B:
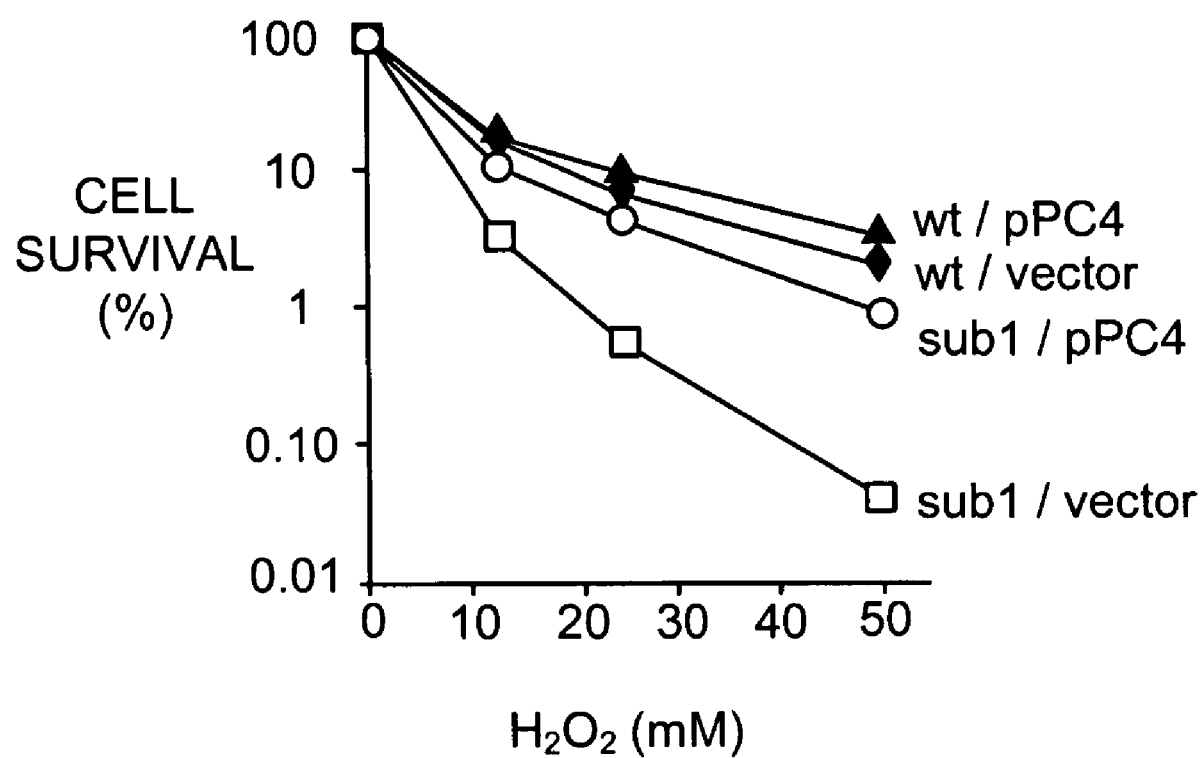
FIG. 4B is a graph showing the peroxide sensitivity (as a function of cell survival) of yeast sub1Δ mutant strain and its suppression by truncated PC4 gene expression. Wild-type yeast carrying the vector pMV611 is indicated (♦), *S. cerevisiae* sub1Δ mutant carrying the vector pMV611 is indicated (□); wild-type carrying the truncated PC4 gene expression plasmid is indicated (▲); and *S. cerevisiae* sub1Δ mutant carrying the truncated PC4 gene expression plasmid is indicated (○).

To determine if the PC4 gene can function to protect against oxidative DNA damage, we tested if it suppresses the peroxide sensitivity of the yeast sub1Δ mutant strain. We constructed a plasmid that expresses the truncated form of PC4 by adding an ATG codon to the 5' end of PC4 beginning with the glutamine 40 codon. This construct corresponds to the PC4 coding sequence of the truncated form of PC4 originally isolated (see FIG. 2). Expression of this clone in yeast results in a complete restoration of peroxide resistance (FIG. 4B), indicating that the truncated form of PC4 can fully substitute for the yeast SUB1 gene and demonstrate that the human PC4 gene, like its yeast counterpart, functions in oxidation protection.

Example 7

The Yeast sub1Δ Mutation Increases Spontaneous and Induced Mutagenesis

Figure 6:
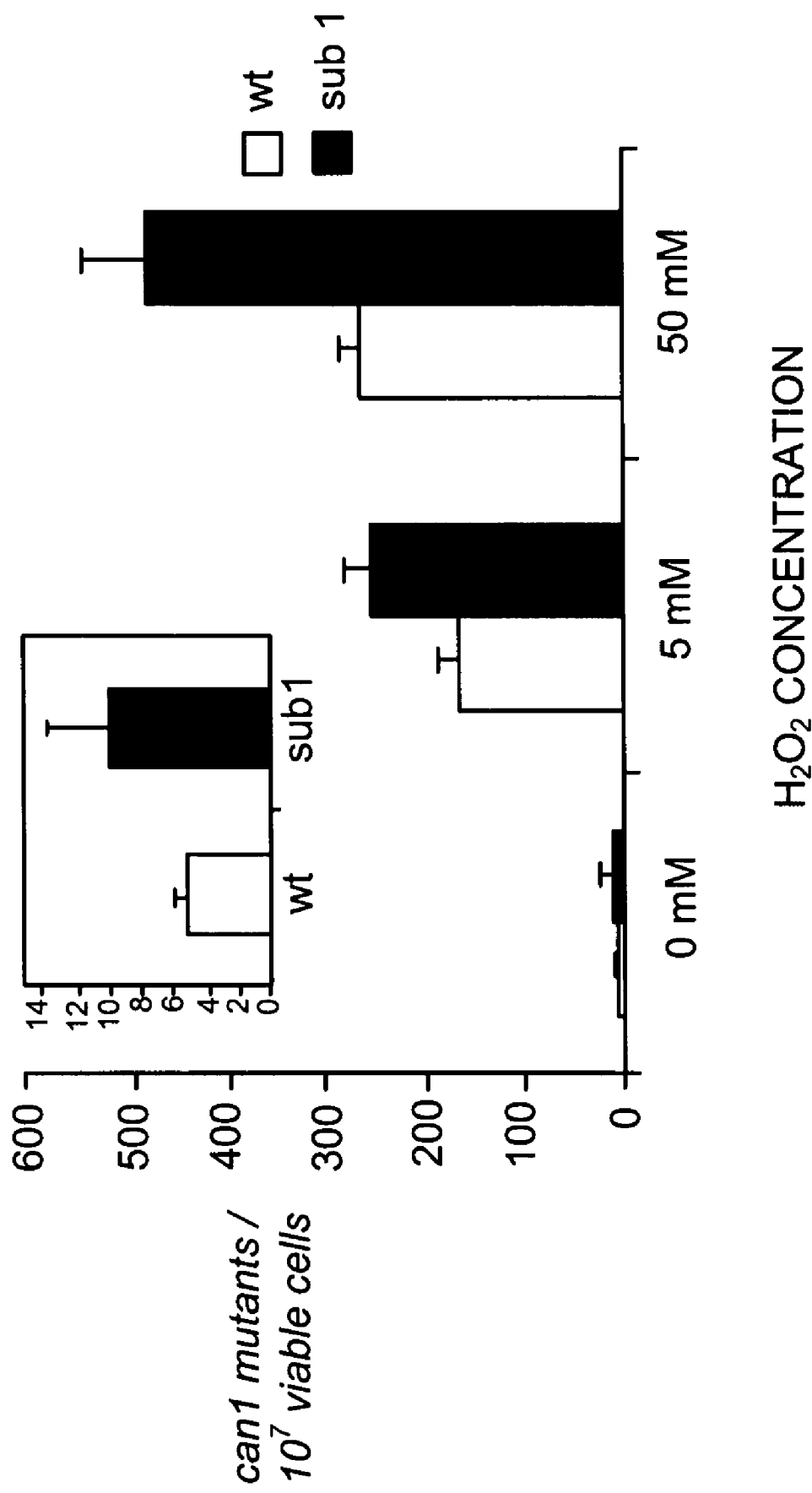
FIG. 6 is a graph showing the reduced spontaneous and induced mutation rate of wild type yeast (grey bars) relative to sub1Δ mutant (black bars) *S. cerevisiae*. The inset shows the difference in spontaneous mutation rate of the two yeast strains (with no exogenous peroxide addition) on a smaller y-axis scale.

Since many mutations affecting peroxide sensitivity also affect spontaneous and peroxide induced mutagenesis, we tested if the sub1Δ mutation acts similarly by measuring the forward mutation frequency to canavanine resistance. FIG. 6 shows that the sub1Δ mutant exhibits a two-fold increase in both spontaneous and peroxide-induced mutagenesis, indicating that Sub1 protects against mutations arising from the low spontaneous production of endogenous ROS and exposure to high levels of exogenous hydrogen peroxide.

Example 8 rad2Δ Partially Suppresses Peroxide Sensitivity of sub1Δ

Figure 7:
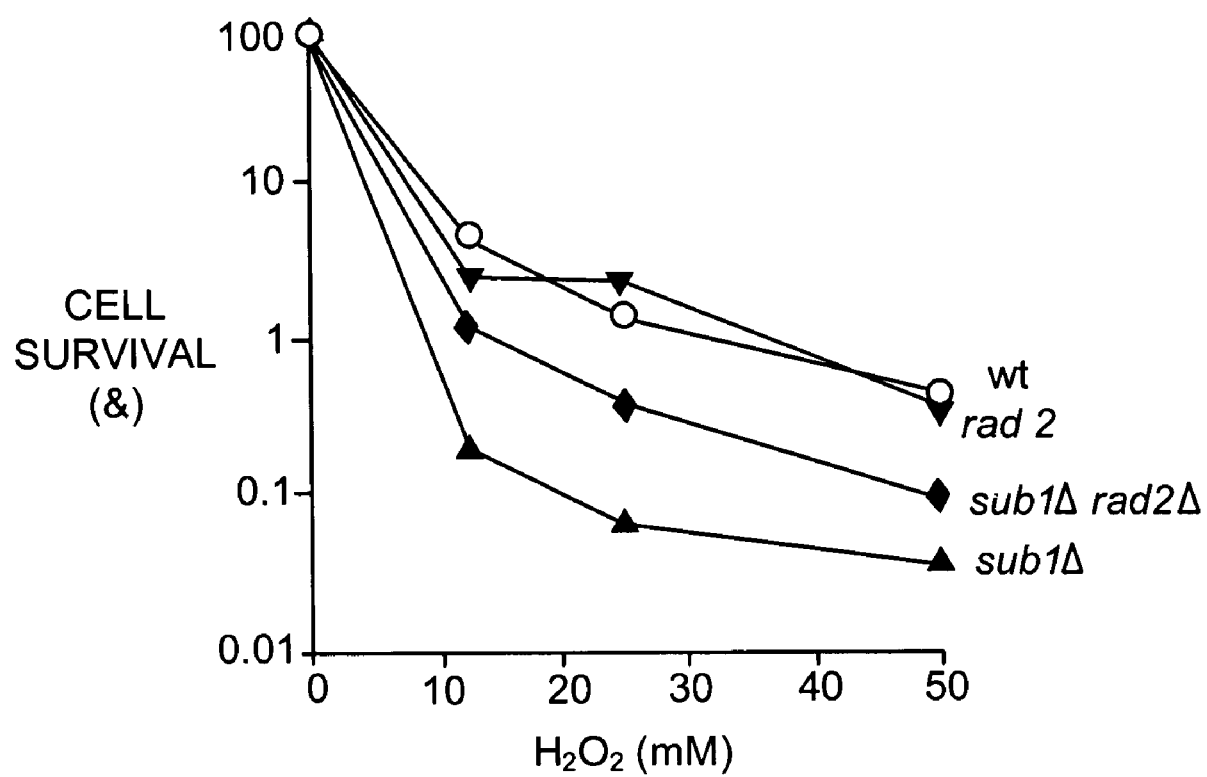
FIG. 7 is a graph showing partial suppression of sub1 hydrogen peroxide sensitivity by rad2. Wild Type (♦), sub1Δ mutant strain (▲), rad2Δ mutant strain (▼) sub1Δ rad2Δ double mutant strain (♦) are indicated.

A non-enzymatic function of the endonuclease XPG is essential for transcription-coupled repair of oxidative damage (Le Page et al., Cell 101:159-71 (2000)) and has also been implicated in transcription per se (Bradsher, Mol. Cell 10:819-29(2000); Lee et al., Cell 109:823-34 (2002)). XPG also stimulates initiation of base excision repair (BER) by the NTH1 glycosylase that removes oxidized pyrimidines, again in a non-enzymatic capacity. Furthermore, XPG also interacts with and stimulates APE1, the major human AP endonuclease activity in BER, and appears to coordinate NTH1 and APE1 function in vitro. Because PC4 and Sub1 also have roles in both transcription and resistance to oxidative damage, we wondered whether they might interact with XPG and its yeast homolog Rad2, respectively. We therefore constructed a sub1Δ rad2Δ double mutant strain to see if these mutations are epistatic or result in increased peroxide sensitivity. Briefly, the sub1Δ was crossed with a rad2Δ strain of S. cerevisiae (Wang et al., Mol. Cell. Biol., 24:6084-93 (2004)). Interestingly, the rad2Δ mutation partially rescues the sub1Δ mutant strain, reducing its peroxide sensitivity (FIG. 7).

Example 9

Direct Interaction of PC4 with XPG

Expression and Purification of PC4 and XPG

Full length wild type PC4 was expressed in the E. coli BL21(DE3) strain and purified according to the methods of Ge et al., Methods Enzymol. 274:57-71(1996). The cDNA for human XPG was inserted into a pFASTBAC™ vector (Invitrogen, Carlsbad, Calif.), expressed in High5 insect cells, and purified to 95% homogeneity essentially as described Evans, EMBO J., 16:625-38 (1997). For use only in the "far western" assays, a heart muscle kinase (HMK) recognition sequence tag, RRASV (SEQ ID NO:8), was added at the C-terminus.

Protein-Protein Interaction Assays

For "far western" analysis, human PC4 protein (1.5 µg), human Nth1 protein (2.1 µg) and E. coli EndoIII (3 µg) were separated on SDS-PAGE (pre-cast 4-20% gel, BioRad), transferred to a PVDF membrane, and stained with Ponceau S to visualize the proteins on the membrane. The membrane was then blocked with a blocking buffer (25 mM Hepes-KOH (pH 7.7), 25 mM NaCl, 5 mM $MgCl_2$, 1 mM DTT, 1% nonfat milk and 0.1% NP-40) for 2 hours at 4° C. and probed overnight at 4° C. on a rocker with blocking buffer containing 150 mM KCl and $^{32}$P-labeled XPG with a heart muscle kinase (HMK) tag. The membrane was washed with washing buffer (25 mM Hepes-KOH (pH 7.7), 25 mM NaCl, 150 mM KCl, 5 mM $MgCl_2$, 1 mM DTT, 1% nonfat milk and 0.5% NP-40), and interactions were visualized by both phosphorimager and autoradiography. For slot-blot analysis 1 µg each of PC4, hNth1 and EndoIII were applied to a nitrocellulose membrane, and the membrane was processed as above.

Figure 8B:
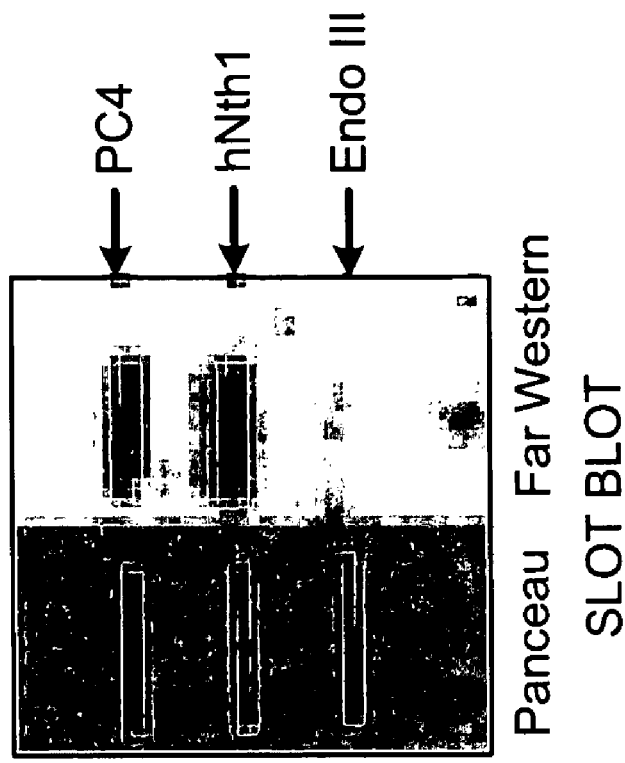
FIG. 8B is a composite of two images of a nitrocellulose membrane blotted with the same three proteins as in FIG. 8A in a slot blot protocol. The left side is an image of the membrane stained with Ponceau S to show equal protein loads. The right hand side shows the same membrane blotted with $^{32}$P-labelled XPG-HMK, again confirming that XPG-HMK bound both PC-4 an hNth1, but not Endo III.
Figure 8A:
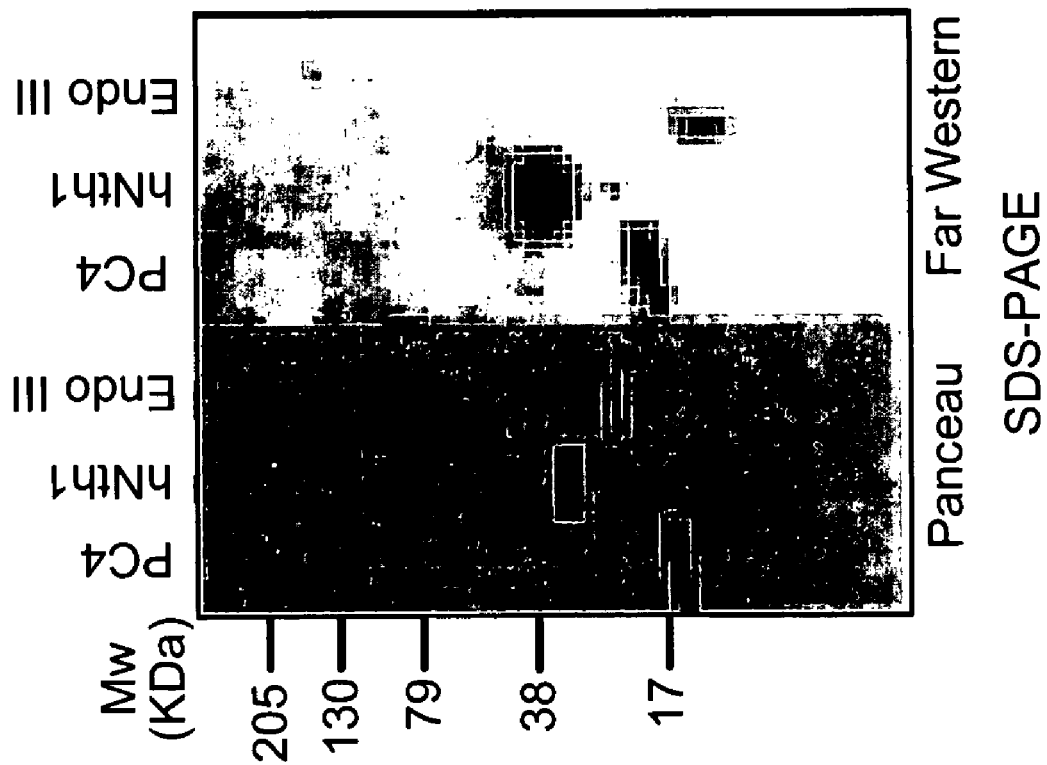
FIG. 8A is a composite of two images of a nitrocellulose membrane onto which PC4, human Nth1 (positive control) and E. coli Endo III (negative control) proteins were transferred from an SDS-PAGE gel. The left side of the panel is an image of the membrane stained by Ponceau S showing successful transfer of the three proteins. The right hand side is an image of the same membrane blotted with $^{32}$P-labelled XPG-HMK, which bound both PC-4 and hNth1, but not Endo III.

Since Sub1 evidently functions in a pathway involving Rad2, we tested the possibility of direct interaction between the human PC4 and XPG proteins by "far western" analysis. To test PC4-XPG interaction, $^{32}$P-labeled XPG was used as a probe for PC4 transferred onto a membrane from an SDS-PAGE gel. A strong signal appears at the position corresponding to PC4, indicating that XPG and PC4 directly interact in the absence of DNA (FIG. 8A). Under these conditions, XPG bound to the positive control human NTH1, but did not bind to its E. coli homologue EndoIII, the negative control. To eliminate the possibility that the interaction might be due to denaturation of PC4 during the electrophoresis step, we also tested native PC4 bound directly to a membrane in a slot blot assay (FIG. 8B). Notably, the interaction of PC4 and XPG is preserved, providing additional evidence for its specificity.

Example 10

PC4 Binding to Bubble Substrates is Enhanced by XPG

The sequence of the oligonucleotides used to form the bubble DNA substrate for the electrophoretic mobility shift assay were as follows, with the central unpaired region of the substrates highlighted in bold: 10T-strand: 5'-GGGCAGA-CAACGTGGCGCTG-TTTTTTTTTTGTGTCCTAGCA-CAGCGTATG-3' (SEQ ID NO:9)

10C-strand: 5'-CATACGCTGTGCTAGGACAC-CCCCCCCCCC-CAGCGCCACGTTGTCTGCCC-3' (SEQ ID NO:10).

The 10T-strand was 5'-end labeled with T4 polynucleotide kinase and [γ-$^{32}$P]ATP and annealed with the complementary 10C-strand by heating for 3 minutes at 90° C. and cooled to room temperature. The resulting DNA bubble substrate was gel purified. Fifty fmol of $^{32}$P-labeled bubble-DNA was incubated at room temperature with XPG, PC4, or both for 20 minutes in a 20 µl reaction mixture containing 10 mM Hepes-KOH (pH 7.5), 110 mM KCl, 1 mM EDTA, 1 mM DTT, 4% glycerol, and 0.2 µg poly[d(IC)-d(IC)]. After the incubation, the samples were loaded on a 4.5% non-denaturing polyacrylamide gel (19:1, acrylamide:bis-acrylamide). Electrophoresis was performed under refrigeration at 150 V for 2 hours in 0.5×TBE buffers. The gels were visualized by phosphorimager and analyzed using ImageQuant™ software (Molecular Dynamics).

Figure 9A:
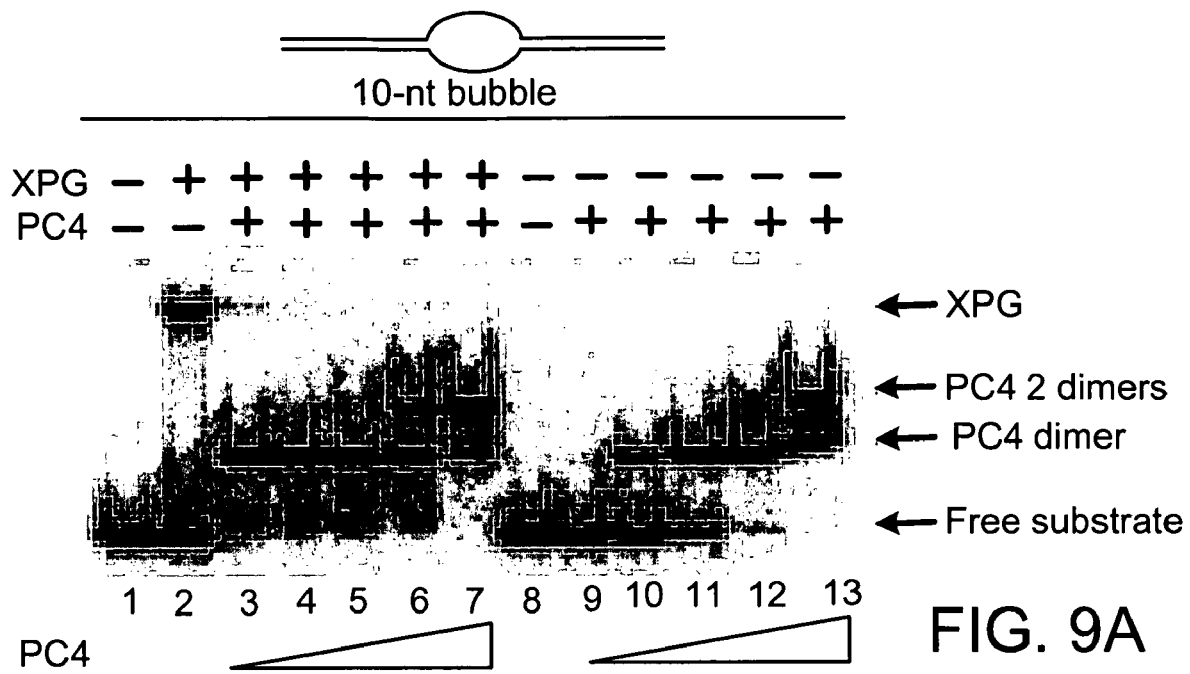
FIG. 9A is an image of a non-denaturing polyacrylamide gel through which different reaction mixtures were electrophoresed. 2.5 nM of the 10-nt bubble DNA substrate was incubated with 41 nM of purified XPG (lanes 2-7) or without XPG (lanes 9-13). Reaction mixtures were supplemented with 44 nM (lanes 3 and 9), 88 nM (lanes 4 and 10), 176 nM (lanes 5 and 11), 352 nM (lanes 6 and 12) and 704 nM (lanes 7 and 13) of human PC4 protein, respectively. Samples were loaded onto a 4.5% native gel and electrophoresis was conducted at 150 V for 2 hours at 4° C. The gel was dried and exposed on a phosphorimager screen. No protein was added in lanes 1 and 8.

The preferred DNA substrates for binding by PC4 are DNA bubble structures. Perhaps not coincidentally, XPG also binds stably, specifically, and with high affinity to DNA bubbles resembling in size the open regions associated with transcription. To determine if these two proteins compete for this substrate or interact synergistically, we tested if the presence of XPG affects PC4 binding by full length PC4 protein to a DNA bubble substrate having a central 10 nucleotide unpaired region. XPG alone bound to this substrate to form a slowly-migrating complex (FIG. 9A, lane 2). In the absence of XPG, PC4 also bound specifically to the 10 nucleotide DNA bubble (FIG. 9A, lanes 9-13), with complete binding at 352 nM (lane 12). We also observed an additional shifted band that appears only at the highest concentration assayed, 704 nM (FIG. 9A, lane 13). Since it is known that PC4 binds as a dimer, we postulate that the slower-migrating shifted species represents a double complex of PC4 dimers bound to DNA as has been previously observed by others.

Figure 9B:
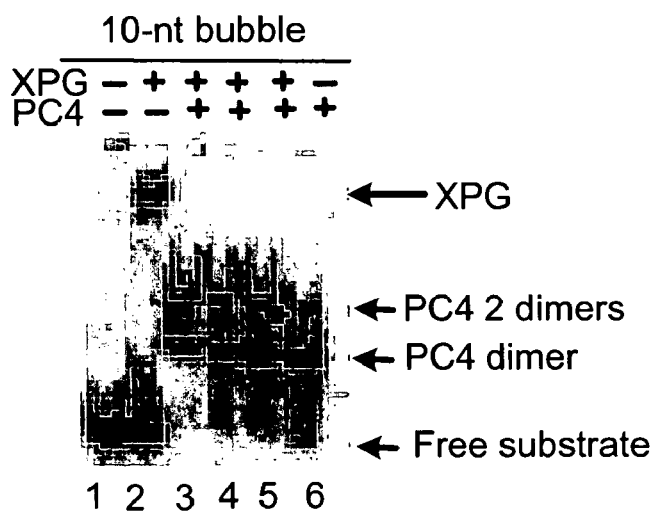
FIG. 9B is an image of a non-denaturing polyacrylamide gel through which different reaction mixtures were electrophoresed. In all reactions 44 nM of XPG and 352 nM PC4 protein and the same DNA bubble substrates shown in FIG. 8 were used. XPG was first incubated with the DNA bubble substrate (lane 2 and 3); PC4 protein was then added (lane 3), or PC4 protein was first incubated with the DNA bubble substrate followed by XPG addition (lane 4); or XPG and PC4 mixed first, then added to the DNA bubble substrate (lane 5); or PC4 alone was incubated with the substrate (lane 6). Samples were run in a 4.5% native gel and electrophoresis was conducted at 150 V for 2 hours in the cold. The gel was dried and exposed on a phosphorimager screen.

To determine if XPG affects PC4 interaction with DNA bubbles, we pre-incubated the 10 bp bubble DNA with XPG and then added PC4 at varying concentrations (FIG. 9A, lanes 3-7). XPG strongly stimulated PC4 binding, with complete binding achieved at the lowest PC4 protein concentration analyzed (44 nM, lane 3) as compared to 352 nM in the absence of XPG Correspondingly, the tetramer-bound complex appears at lower concentrations (352 nM, lane 6) in the presence of XPG In no case did we observe a trimeric complex of XPG, PC4, and DNA. At approximately equimolar ratios of PC4 and XPG (44 nM, lane 3), there appears to be a complete replacement of XPG by PC4 in the protein-bound DNA complexes. To test if PC4-mediated displacement of XPG is dependent upon the order of addition, the proteins were added in either order, or simultaneously. In all cases, only the complexes migrating to the positions detected when PC4 alone is added are seen (FIG. 9B, lanes 3-5). These results suggest that XPG recruits PC4 to bubble-containing DNA substrates and that binding of PC4 displaces XPG from the bubble substrate.

Example 11

Additional Human cDNAs that Suppress Oxidative DNA Damage in E. coli

A number of human genes were found to suppress the mutator phenotype of E. coli. Briefly, the E. coli fpg mutY lacZcc104 strain MV4709 with a human cDNA library constructed in a bacterial expression vector (Perkins et al., Proc. Natl. Acad. Sci. USA, 96:2204-2209 (1999) and Volkert, Proc. Natl. Acad. Sci. USA, 97:14530-14535(2000)), and the individual transformed colonies were assayed for suppression of the spontaneous mutator phenotype. Plasmids that suppressed the mutator phenotype of a cc104 fpg mutY strain were identified by the presence of very few visible blue papillae (revertants).

Tables 3-5 list the 286 human cDNA clones identified as antimutators from a genetic screen using cc104 fpg mutY designed to search for gene products that suppress oxidative DNA mutagenesis. These clones were isolated from a pilot screen representing ~20,000 cDNAs. The antimutagenic activity of each clone was individually validated by at least two rounds of papillation assays and three repeats of quantitative measurement of the spontaneous mutation frequency.

The 286 clones were divided into three tables according to similarities of the translated protein sequences to published results in the NCBI databases: Table 3: 222 sequences with at least 50% identity and 80% similarity to known genes; Table 4: 14 sequences with less than 50% identity or 80% similarity to known genes; and Table 5: 50 unknown or unnamed sequences. Clones corresponding to the same gene or clones coding for proteins of similar functions were grouped together.

| Clone # | Accession # | Sequence Identifier | Gene Name |
|---|---|---|---|
| 10 | NP_006803 | SEQ ID NO:11 | the OS-9 gene amplified in human sarcomas |
| 15 | NP_008982 | SEQ ID NO:12 | FAS-associated factor 1 isoform a; TNFRSF6-associated factor 1 |
| 18 | NP_065134 | SEQ ID NO:13 | nucleoporin, Nup107 |
| 20 | AAB02411 | SEQ ID NO:14 | CoxII/D-loop DNA fusion protein (Age-related human mtDNA deletions) |
| 37 | AAH48094 | SEQ ID NO:15 | a metallopeptidase, angiotensin-converting enzyme 2 (ACE2) |
| 41 | Q9BW71 | SEQ ID NO:16 | HIRA-interacting protein 3 (HIRIP3, a novel histone-binding protein) |
| 58 | NP_006704 | SEQ ID NO:17 | activated RNA polymerase II transcription cofactor 4 (PC4) |
| 67 | NP_060906 | SEQ ID NO:18 | allantoicase isoform a; allantoate amidinohydrolase |
| 68 | Q9P0W8 | SEQ ID NO:19 | Spermatogenesis associated protein 7 (Spermatogenesis associated protein HSD3) (HSD-3.1) |
| 78 | NP_057199 | SEQ ID NO:20 | ankyrin repeat and SOCS box-containing protein 3 isoform a (ASB3) |
| 84 | NP_003711 | SEQ ID NO:21 | Down syndrome critical region protein 2 isoform a; chromosome 21 leucine-rich protein (C21-LRP) |
| 87 | NP_000262 | SEQ ID NO:22 | Niemann-Pick disease, type C1 |
| 89 | CAD24472 | SEQ ID NO:23 | FRA10AC1, encoding a nuclear protein |
| 112 | AAH50551 | SEQ ID NO:24 | BCL2-associated athanogene 5 (BAA74896: KIAA0873; NP_004864: BAG-family molecular chaperone regulator-5 (BAG-5)) |
| 122 | NP_872291 | SEQ ID NO:25 | cytoplasmic polyadenylation element binding protein 2 isoform B |
| 142 | Q9UHH9 | SEQ ID NO:26 | Inositol hexakisphosphate kinase 2 (InsP6 kinase 2) |
| 148 | NP_115989 | SEQ ID NO:27 | testes development-related NYD-SP17 |
| 151 | Q04323 | SEQ ID NO:28 | UBA/UBX 33.3 kDa protein (AAH01372: unknown protein LOC51035) |
| 168 | NP_060059 | SEQ ID NO:29 | B-cell translocation gene 4 (Anti-proliferation factor BTG/TOB family) |
| 172 | NP_067034 | SEQ ID NO:30 | Buster1 transposase-like protein (go_function: DNA binding) |
| 195 | NP_006404 | SEQ ID NO:31 | ribonuclease P (30 kD) |
| 197 | NP_775087 | SEQ ID NO:32 | interleukin 28 receptor, alpha isoform 2 |
| 202 | NP_055392 | SEQ ID NO:33 | bromodomain containing protein 1; BR140-like gene (domain with conserved PWWP motif; conservation of Pro-Trp-Trp-Pro residues) |
| 210 | NP_778146 | SEQ ID NO:34 | pote protein; Expressed in prostate, ovary, testis, and placenta |
| 223 | NP_005993 | SEQ ID NO:35 | ubiquitin carboxyl-terminal esterase L3 (ubiquitin thiolesterase) |
| 234 | AAH05223 | SEQ ID NO:36 | Zona pellucida binding protein |
| 239 | NP_115878 | SEQ ID NO:37 | proacrosin binding protein sp32 precursor (ACRBP, cancer/testis antigen) |
| 240 | AAH01906 | SEQ ID NO:38 | MTX1 |
| 246 | NP_003877 | SEQ ID NO:39 | A-kinase anchor protein 4 isoform 1; A-kinase anchor protein 82 kDa; testis-specific gene HI |

-continued

| Clone # | Accession # | Sequence Identifier | Gene Name |
|---|---|---|---|
| 252 | NP_004138 | SEQ ID NO:40 | developmentally regulated GTP binding protein 1 (Drg-1 is a candidate metastasis suppressor gene for prostate cancer) |
| 253 | NP_002069 | SEQ ID NO:41 | golgi autoantigen, golgin subfamily a, 4; golgin-245; trans-Golgi p230; 256 kDa golgin |
| 255 | NP_001001935 | SEQ ID NO:42 | ATP synthase, H+ transporting, mitochondrial F1 complex, alpha subunit isoform b |
| 279 | AAL59602 | SEQ ID NO:43 | paraspeckle protein 1 beta isoform |
| 288 | NP_112196 | SEQ ID NO:44 | N2,N2-dimethylguanosine tRNA methyltransferase-like (CAC00613: isoform 1) |
| 291 | AAH14079 | SEQ ID NO:45 | PMPCB; (mitochondrial processing peptidase beta) |
| 297 | NP_742000 | SEQ ID NO:46 | COBW domain-containing protein 2 |
| 299 | NP_055485 | SEQ ID NO:47 | basic leucine zipper and W2 domains 1; basic leucine-zipper protein BZAP45 (BAA02795: KIAA0005) |
| 300 | P49755 | SEQ ID NO:48 | Transmembrane protein Tmp21 precursor (Tmp-21-I) |
| 306 | AAK20832 | SEQ ID NO:49 | spermatid perinuclear double-stranded RNA-binding protein |
| 344 | AAH00678 | SEQ ID NO:50 | eEF1D eukaryotic translation elongation factor 1 delta (guanine nucleotide exchange protein) |
| 349 | NP_009145 | SEQ ID NO:51 | SEC63-like protein; SEC63, endoplasmic reticulum translocon component (*S. cerevisiae*) like |
| 377 | NP_002703 | SEQ ID NO:52 | protein phosphatase 1, regulatory subunit 7 |
| 393 | S33990 | SEQ ID NO:53 | finger protein ZNF33A |
| 403 | AAH32466 | SEQ ID NO:54 | PP3856; Nicotinic acid phosphoribosyltransferase |
| 404 | NP_004522 | SEQ ID NO:55 | molybdopterin synthase large subunit MOCS2B; molybdenum cofactor biosynthesis protein E; MPT synthase |
| 409 | NP_056109 | SEQ ID NO:56 | TRIM37; tripartite motif-containing 37; MUL protein; peroxisomal RING-B-box-coiled-coil protein |
| 411 | NP_056477 | SEQ ID NO:57 | selective LIM binding factor, rat homolog |
| 416 | NP_00452 | SEQ ID NO:58 | nucleosome assembly protein 1-like 1; HSP22-like protein interacting protein; NAP-1 related protein |
| 421 | NP_112168 | SEQ ID NO:59 | serine/threonine kinase 33 |
| 425 | CAF18565 | SEQ ID NO:60 | myomesin 1 (structural protein of the sarcomere) |
| 436 | NP_008975 | SEQ ID NO:61 | katanin p60 subunit A 1 (the AAA family of ATPase) |
| 448 | NP_060962 | SEQ ID NO:62 | T-LAK cell-originated protein kinase; spermatogenesis-related protein kinase; PDZ-binding kinase; PBK; MAPKK-like protein kinase; serine/threonine protein kinase |
| 453 | NP_932351 | SEQ ID NO:63 | ring finger protein 148; goliath-related E3 ubiquitin ligase 3-like |
| 495 | AAD49610 | SEQ ID NO:64 | voltage-dependent anion channel VDAC3 (mitochondrial porin) |
| 498 | NP_065717 | SEQ ID NO:65 | CDC-like kinase 4; protein serine threonine kinase Clk4 |
| 499 | NP_11619 | SEQ ID NO:66 | ATPase family, AAA domain containing 1 |
| 501 | P55786 | SEQ ID NO:67 | Puromycin-sensitive aminopeptidase (PSA) |
| 511 | NP_055209 | SEQ ID NO:68 | growth hormone inducible transmembrane protein; PTD010 |
| 514 | NP_065691 | SEQ ID NO:69 | RP42 homolog; squamous cell carcinoma-related oncogene |
| 520 | NM_022443 | SEQ ID NO:70 | MFL1 human Myeloid Leukemia Factor 1 |
| 521 | CAC10381 | SEQ ID NO:71 | dJ545L17.2 (novel protein similar to RAD21 (*S. pombe*) homolog (KIAA0078)) |
| 529 | AAC51317 | SEQ ID NO:72 | karyopherin beta 3 (nuclear transport factor) |
| 555 | NP_000777 | SEQ ID NO:73 | cytochrome P450, family 51; cytochrome P450, 51 (lanosterol 14-alpha-demethylase) |
| 563 | NP_003275 | SEQ ID NO:74 | transition protein 1 (during histone to protamine replacement in Spermatogenesis; DNA binding; chromosome condensation) |
| 564 | NP_003784 | SEQ ID NO:75 | cathepsin F (papain family cysteine proteinases in lysosome) |
| 567 | NP_006634 | SEQ ID NO:76 | Serologically defined colon cancer antigen 3 |
| 572 | NP_003901 | SEQ ID NO:77 | maternal G10 transcript |
| 585 | NP_057018 | SEQ ID NO:78 | nucleolar protein NOP5/NOP58 (chaperone; snoRNP binding; rRNA processing) |
| 601 | NP_079510 | SEQ ID NO:79 | recombination protein REC14 (similar to *S. pombe* Rec14p and *S. cerevisiae* Ski8p; essential for meiotic recombination) |
| 607 | NP_009109 | SEQ ID NO:80 | serine/threonine kinase receptor associated protein; unr-interacting protein |
| 616 | NP_061856 | SEQ ID NO:81 | nucleolar protein family A, member 1; GAR1 (rRNA processing and modification) |

-continued

| Clone # | Accession # | Sequence Identifier | Gene Name |
|---|---|---|---|
| 617 | NP_006651 | SEQ ID NO:82 | ClpX caseinolytic protease X homolog; energy-dependent regulator of proteolysis; ClpX (caseinolytic protease X, *E. coli*) homolog |
| 619 | NP_064629 | SEQ ID NO:83 | choline phosphotransferase 1 |
| 622 | AAK31162 | SEQ ID NO:84 | ubiquitin A-52 residue ribosomal protein L40e fusion product 1 |
| 624 | NP_694984 | SEQ ID NO:85 | bromo domain-containing protein disrupted in leukemia; bromodomain and WD repeat domain containing 3 variants of BRWD3 |
| 673 | AAK27309 | SEQ ID NO:86 | nucleoporin NYD-SP7 |
| 674 | NP_056972 | SEQ ID NO:87 | hook homolog 1; hook1 protein (nonselective vesicle transport) |
| 685 | DAA04877 | SEQ ID NO:88 | TPA: olfactory receptor OR15-5 (seven transmembrane helix receptor) |
| 64 | P49189 | SEQ ID NO:89 | Aldehyde dehydrogenase, E3 isozyme (Gamma-aminobutyraldehyde dehydrogenase) (R-aminobutyraldehyde dehydrogenase) |
| 672 | NP_000687 | SEQ ID NO:90 | aldehyde dehydrogenase 9A1; gamma-aminobutyraldehyde dehydrogenase; 4-trimethylaminobutyraldehyde dehydrogenase; aldehyde dehydrogenase E3 isozyme; aldehyde dehydrogenase (NAD+) |
| 65 | Q9H9S4 | SEQ ID NO:91 | Calcium binding protein 39-like (Mo25-like protein) (AAQ93064: antigen MLAA-34) |
| 219 | AAH10993 | SEQ ID NO:92 | CAB39L (MO25-like protein) |
| 379 | AAH10993 | SEQ ID NO:92 | CAB39L protein; AAQ93064: antigen MLAA-34 |
| 1 | NP_055625 | SEQ ID NO:93 | centrosome-associated protein 350 |
| 634 | NP_055625 | SEQ ID NO:93 | centrosome-associated protein 350 |
| 206 | AAP82002 | SEQ ID NO:94 | CARP1; cell-cycle and apoptosis regulatory protein 1 |
| 211 | NP_060707 | SEQ ID NO:95 | CCAR1; cell-cycle and apoptosis regulatory protein 1 |
| 231 | NP_060707 | SEQ ID NO:95 | CCAR1; cell-cycle and apoptosis regulatory protein 1 |
| 8 | NP_008949 | SEQ ID NO:96 | CEP1; centrosomal protein 1; centriole associated protein; centriolin |
| 324 | NP_008949 | SEQ ID NO:96 | CEP1; centrosomal protein 1; centriole associated protein; centriolin |
| 459 | NP_008949 | SEQ ID NO:96 | CEP1; centrosomal protein 1; centriole associated protein; centriolin |
| 462 | NP_008949 | SEQ ID NO:96 | CEP1; centrosomal protein 1; centriole associated protein; centriolin |
| 635 | NP_008949 | SEQ ID NO:96 | CEP1; centrosomal protein 1; centriole associated protein; centriolin |
| 82 | NP_006188 | SEQ ID NO:97 | autoantigen pericentriolar material 1 (PCM1) |
| 153 | A54103 | SEQ ID NO:98 | autoantigen pericentriolar material 1 (PCM1) |
| 356 | AAH17059 | SEQ ID NO:99 | Interferon, gamma-inducible protein 16 (IFI 16, dsDNA-binding, repressor of transcription) |
| 503 | AAH17059 | SEQ ID NO:99 | Interferon, gamma-inducible protein 16 |
| 558 | NP_057506 | SEQ ID NO:100 | ring finger protein 141; C3HC4-like zinc finger protein (ubiquitin-protein ligase activity) |
| 559 | NP_057506 | SEQ ID NO:100 | ring finger protein 141; C3HC4-like zinc finger protein (ubiquitin-protein ligase activity) |
| 606 | S34632 | SEQ ID NO:101 | DnaJ (Hsp40) homolog |
| 658 | NP_005871 | SEQ ID NO:102 | DnaJ subfamily A member 2; cell cycle progression 3 protein; HIRA interacting protein 4 (HIRIP4) |
| 3 | NP_001753 | SEQ ID NO:103 | chaperonin containing TCP1, subunit 6A (zeta 1); chaperonin containing T-complex subunit 6 |
| 12 | NP_006422 | SEQ ID NO:104 | chaperonin containing TCP1, subunit 2 (beta); chaperonin containing t-complex polypeptide 1, beta subunit |
| 32 | NP_036205 | SEQ ID NO:105 | chaperonin containing TCP1, subunit 5 (epsilon) |
| 77 | Q92526 | SEQ ID NO:106 | T-complex protein 1, zeta-2 subunit (TCP-1-zeta-2) (CCT-zeta-2) (TCP-1-zeta-like) (CCT-zeta-like) (Testis-specific Tcp20) (Testis-specific protein TSA303) |
| 86 | NP_036205 | SEQ ID NO:105 | chaperonin containing TCP1, subunit 5 (epsilon) |
| 233 | Q92526 | SEQ ID NO:106 | T-complex protein 1, zeta-2 subunit (TCP-1-zeta-2) (CCT-zeta-2) (TCP-1-zeta-like) (CCT-zeta-like) (Testis-specific Tcp20) (Testis-specific protein TSA303) |
| 290 | CAG33352 | SEQ ID NO:107 | CCT2; chaperonin containing TCP1, subunit 2 (beta) |
| 314 | NP_036205 | SEQ ID NO:105 | chaperonin containing TCP1, subunit 5 (epsilon) |
| 346 | NP_110379 | SEQ ID NO:108 | t-complex 1; T-complex locus TCP-1; T-complex protein 1, alpha subunit (TCP-1-alpha) (CCT-alpha) |
| 432 | NP_110379 | SEQ ID NO:108 | t-complex 1; T-complex locus TCP-1; T-complex protein 1, alpha subunit (TCP-1-alpha) (CCT-alpha) |
| 438 | NP_036205 | SEQ ID NO:105 | chaperonin containing TCP1, subunit 5 (epsilon) |
| 493 | NP_036205 | SEQ ID NO:105 | chaperonin containing TCP1, subunit 5 (epsilon) |

-continued

| Clone # | Accession # | Sequence Identifier | Gene Name |
|---|---|---|---|
| 494 | Q92526 | SEQ ID NO:106 | T-complex protein 1, zeta-2 subunit (TCP-1-zeta-2) (CCT-zeta-2) (TCP-1-zeta-like) (CCT-zeta-like) (Testis-specific Tcp20) (Testis-specific protein TSA303) |
| 550 | Q92526 | SEQ ID NO:106 | T-complex protein 1, zeta-2 subunit (TCP-1-zeta-2) (CCT-zeta-2) (TCP-1-zeta-like) (CCT-zeta-like) (Testis-specific Tcp20) (Testis-specific protein TSA303) |
| 630 | NP_036205 | SEQ ID NO:105 | chaperonin containing TCP1, subunit 5 (epsilon) |
| 229 | CAC39480 | SEQ ID NO:109 | putative TCPTP-interacting protein; FLJ10579 protein; cerebral protein-10 |
| 44 | NP_653274 | SEQ ID NO:110 | chemokine-like factor superfamily 2 |
| 46 | NP_653274 | SEQ ID NO:110 | chemokine-like factor superfamily 2 |
| 284 | NP_653274 | SEQ ID NO:110 | chemokine-like factor superfamily 2 |
| 423 | NP_653274 | SEQ ID NO:110 | chemokine-like factor superfamily 2 |
| 445 | AAN73038 | SEQ ID NO:111 | chemokine-like factor super family 2 |
| 263 | AAH66938 | SEQ ID NO:112 | DEAD (Asp-Glu-Ala-Asp) box polypeptide 43 |
| 267 | NP_060802 | SEQ ID NO:113 | DDX19-like protein; RNA helicase |
| 296 | NP_004387 | SEQ ID NO:114 | DEAD (Asp-Glu-Ala-Asp) box polypeptide 5; DEAD box-5; DEAD/H (Asp-Glu-Ala-Asp/His) box polypeptide 5 (RNA helicase, 68 kD) |
| 318 | AAH66938 | SEQ ID NO:112 | DEAD (Asp-Glu-Ala-Asp) box polypeptide 43 |
| 385 | AAH66938 | SEQ ID NO:112 | DEAD (Asp-Glu-Ala-Asp) box polypeptide 43 |
| 477 | AAH66938 | SEQ ID NO:112 | DEAD (Asp-Glu-Ala-Asp) box polypeptide 43 |
| 70 | AAH12547 | SEQ ID NO:115 | Eukaryotic translation initiation factor 4A, isoform 2 |
| 74 | AAF64266 | SEQ ID NO:116 | BM-010; similar to eukaryotic translation initiation factor 4A1; initiation factor eIF-4A long form [Mus musculus] |
| 163 | AAF64266 | SEQ ID NO:116 | BM-010; similar to eukaryotic translation initiation factor 4A1; initiation factor eIF-4A long form [Mus musculus] |
| 220 | NP_003749 | SEQ ID NO:117 | eukaryotic translation initiation factor 3, subunit 1 (alpha, 35 kD) |
| 230 | AAH16295 | SEQ ID NO:118 | EIF4A2 protein (Superfamily II DNA and RNA helicases [DNA replication, recombination, and repair/Transcription/Translation, ribosomal structure and biogenesis]) |
| 235 | AAH15842 | SEQ ID NO:119 | Eukaryotic translation initiation factor 4A, isoform 2 |
| 440 | AAH15842 | SEQ ID NO:119 | Eukaryotic translation initiation factor 4A, isoform 2 |
| 566 | Q92896 | SEQ ID NO:120 | GLG1; Golgi apparatus protein 1 precursor (Golgi sialoglycoprotein MG-160) (E-selectin ligand 1) (ESL-1) (Cysteine-rich fibroblast growth factor receptor) (CFR-1) |
| 626 | Q92896 | SEQ ID NO:120 | GLG1; Golgi apparatus protein 1 precursor (Golgi sialoglycoprotein MG-160) (E-selectin ligand 1) (ESL-1) (Cysteine-rich fibroblast growth factor receptor) (CFR-1) |
| 35 | NP_055987 | SEQ ID NO:121 | HBxAg transactivated protein 2 |
| 76 | NP_055987 | SEQ ID NO:121 | HBxAg transactivated protein 2 |
| 592 | NP_055987 | SEQ ID NO:121 | HBxAg transactivated protein 2 |
| 4 | NP_002119 | SEQ ID NO:122 | high-mobility group box 1; high mobility group box 1; high-mobility group (nonhistone chromosomal) protein 1; Sulfoglucuronyl carbohydrate binding protein; Amphoterin |
| 119 | NP_002120 | SEQ ID NO:123 | high-mobility group box 2; high-mobility group (nonhistone chromosomal) protein 2 |
| 120 | NP_002120 | SEQ ID NO:123 | high-mobility group box 2; high-mobility group (nonhistone chromosomal) protein 2 |
| 251 | NP_002120 | SEQ ID NO:123 | high-mobility group box 2; high-mobility group (nonhistone chromosomal) protein 2 |
| 322 | NP_064620 | SEQ ID NO:124 | HMG-BOX transcription factor BBX; x 001 protein; HBP2 |
| 419 | AAH00903 | SEQ ID NO:125 | HMGB2 protein |
| 627 | NP_002120 | SEQ ID NO:123 | high-mobility group box 2; high-mobility group (nonhistone chromosomal) protein 2 |
| 132 | AAH07950 | SEQ ID NO:126 | HNRPU protein; heterogeneous nuclear ribonucleoprotein U; hnRNP U |
| 304 | AAH07950 | SEQ ID NO:126 | HNRPU protein; heterogeneous nuclear ribonucleoprotein U; hnRNP U |
| 347 | NP_004957 | SEQ ID NO:127 | heterogeneous nuclear ribonucleoprotein F; nucleolin-like protein; HNRPF |
| 374 | CAD98043 | SEQ ID NO:128 | hypothetical protein (heterogeneous nuclear ribonucleoprotein R) |
| 485 | XP_208200 | SEQ ID NO:129 | similar to Heterogeneous nuclear ribonucleoprotein A1 (Helix-destabilizing protein) (Single-strand binding protein) (hnRNP core protein A1) (HDP-1) (Topoisomerase-inhibitor suppressed) |

-continued

| Clone # | Accession # | Sequence Identifier | Gene Name |
|---|---|---|---|
| 644 | NP_004492 | SEQ ID NO:130 | heterogeneous nuclear ribonucleoprotein U isoform b; hnRNP U protein; scaffold attachment factor A; p120 nuclear protein |
| 675 | NP_004492 | SEQ ID NO:130 | heterogeneous nuclear ribonucleoprotein U isoform b; hnRNP U protein; scaffold attachment factor A; p120 nuclear protein |
| 356 | AAH17059 | SEQ ID NO:99 | Interferon, gamma-inducible protein 16; IFI 16 |
| 503 | AAH17059 | SEQ ID NO:99 | Interferon, gamma-inducible protein 16; IFI 16 |
| 62 | XP_372122 | SEQ ID NO:131 | similar to KIF27C; Kinesin-like protein |
| 218 | XP_372122 | SEQ ID NO:131 | similar to KIF27C; Kinesin-like protein |
| 500 | NP_064627 | SEQ ID NO:132 | kinesin-like 7; kinesin-like protein 2 |
| 661 | I53799 | SEQ ID NO:133 | kinectin 1; CG-1 antigen; kinesin receptor |
| 676 | NP_064627 | SEQ ID NO:132 | kinesin-like 7; kinesin-like protein 2 |
| 562 | O60669 | SEQ ID NO:134 | Monocarboxylate transporter 2 (MCT 2) |
| 565 | O60669 | SEQ ID NO:134 | Monocarboxylate transporter 2 (MCT 2) |
| 16 | NP_001264 | SEQ ID NO:135 | chromodomain helicase DNA binding protein 4 (CHD-4); Mi-2 beta |
| 353 | NP_001264 | SEQ ID NO:135 | chromodomain helicase DNA binding protein 4 (CHD-4); Mi-2 beta |
| 160 | NP_996670 | SEQ ID NO:136 | MORF-related gene 15 isoform 2; MRG15-2 |
| 193 | NP_006782 | SEQ ID NO:137 | MORF-related gene 15 isoform 1; MRG15-1 (Mortality factor 4-like 1) |
| 339 | NP_006782 | SEQ ID NO:137 | MORF-related gene 15 isoform 1; MRG15-1 (Mortality factor 4-like 1) |
| 384 | AAK07407 | SEQ ID NO:138 | histone acetylase complex subunit MRG15-2 |
| 497 | AAK07407 | SEQ ID NO:137 | histone acetylase complex subunit MRG15-2 |
| 578 | NP_006782 | SEQ ID NO:137 | MORF-related gene 15 isoform 1; MRG15-1 (Mortality factor 4-like 1) |
| 141 | NP_851999 | SEQ ID NO:139 | oxidation resistance 1 |
| 545 | NP_851999 | SEQ ID NO:139 | oxidation resistance 1 |
| 82 | NP_006188 | SEQ ID NO:140 | pericentriolar material 1 (PCM-1) |
| 153 | A54103 | SEQ ID NO:141 | centrosome autoantigen PCM-1 |
| 28 | NP_036538 | SEQ ID NO:142 | PR domain containing 4; PR-domain zinc-finger protein PFM1 |
| 31 | NP_036538 | SEQ ID NO:142 | PR domain containing 4; PR-domain zinc-finger protein PFM1 |
| 439 | NP_036538 | SEQ ID NO:142 | PR domain containing 4; PR-domain zinc-finger protein PFM1 |
| 81 | NP_057567 | SEQ ID NO:143 | PHD finger protein 7 isoform 1; NYD-SP6 |
| 591 | NP_775463 | SEQ ID NO:144 | PHD finger protein 7 isoform 2; TCF20 |
| 536 | AAH62602 | SEQ ID NO:145 | Pinin, desmosome associated protein; nuclear protein SDK3 |
| 582 | NP_002678 | SEQ ID NO:146 | Pinin, desmosome associated protein; nuclear protein SDK3 |
| 124 | NP_002795 | SEQ ID NO:147 | proteasome 26S ATPase subunit 3; human immunodeficiency virus tat transactivator binding protein-1 (TAT-binding protein 1) (TBP-1); proteasome subunit P50 |
| 217 | NP_002796 | SEQ ID NO:148 | proteasome 26S ATPase subunit 5; thyroid receptor interactor 1; proteasome subunit p45; MSUG1 protein; Tat-binding protein homolog 10 |
| 238 | NP_002783 | SEQ ID NO:149 | proteasome alpha 7 subunit isoform 1; proteasome subunit RC6-1; proteasome subunit XAPC7 |
| 244 | NP_002795 | SEQ ID NO:147 | proteasome 26S ATPase subunit 3; human immunodeficiency virus tat transactivator binding protein-1 (TAT-binding protein 1) (TBP-1); proteasome subunit P50 |
| 69 | AAB18361 | SEQ ID NO:150 | ribosomal L5 protein |
| 90 | AAA91344 | SEQ ID NO:151 | TARBP-b; HIV-1 TAR RNA binding protein; similar to 60S RIBOSOMAL PROTEIN L3 |
| 123 | NP_000960 | SEQ ID NO:152 | ribosomal protein L5 |
| 129 | AAA03081 | SEQ ID NO:153 | ribosomal protein L7 |
| 145 | NP_000652 | SEQ ID NO:154 | ribosomal protein L9 |
| 152 | NP_001016 | SEQ ID NO:155 | ribosomal protein S23 |
| 285 | NP_000980 | SEQ ID NO:156 | ribosomal protein L30 |
| 313 | NP_000963 | SEQ ID NO:157 | ribosomal protein L7a |
| 315 | NP_000963 | SEQ ID NO:157 | ribosomal protein L7a |
| 553 | NP_000959 | SEQ ID NO:158 | ribosomal protein L4 |
| 137 | P35237 | SEQ ID NO:159 | Placental thrombin inhibitor (Cytoplasmic antiproteinase) (CAP) (Protease inhibitor 6) (PI-6); SERPINB6 |
| 192 | P35237 | SEQ ID NO:159 | Placental thrombin inhibitor (Cytoplasmic antiproteinase) (CAP) (Protease inhibitor 6) (PI-6); SERPINB6 |
| 414 | P35237 | SEQ ID NO:159 | Placental thrombin inhibitor (Cytoplasmic antiproteinase) (CAP) (Protease inhibitor 6) (PI-6); SERPINB6 |

-continued

| Clone # | Accession # | Sequence Identifier | Gene Name |
|---|---|---|---|
| 475 | P35237 | SEQ ID NO:159 | Placental thrombin inhibitor (Cytoplasmic antiproteinase) (CAP) (Protease inhibitor 6) (PI-6); SERPINB6 |
| 590 | P35237 | SEQ ID NO:159 | Placental thrombin inhibitor (Cytoplasmic antiproteinase) (CAP) (Protease inhibitor 6) (PI-6); SERPINB6 |
| 618 | P35237 | SEQ ID NO:159 | Placental thrombin inhibitor (Cytoplasmic antiproteinase) (CAP) (Protease inhibitor 6) (PI-6); SERPINB6 |
| 79 | Q13435 | SEQ ID NO:160 | Splicing factor 3B subunit 2 (Spliceosome associated protein 145) (SAP 145) (SF3b150) (Pre-mRNA splicing factor SF3b 145 kDa subunit) |
| 182 | NP_057131 | SEQ ID NO:161 | pre-mRNA branch site protein p14; CGI-110 protein; splicing factor 3B, 14 kDa subunit |
| 274 | NP_057131 | SEQ ID NO:161 | pre-mRNA branch site protein p14; CGI-110 protein; splicing factor 3B, 14 kDa subunit |
| 480 | AAH67773 | SEQ ID NO:162 | Similar to splicing factor, arginine/serine-rich 4, isoform d |
| 547 | NP_057131 | SEQ ID NO:161 | pre-mRNA branch site protein p14; CGI-110 protein; splicing factor 3B, 14 kDa subunit |
| 139 | NP_063940 | SEQ ID NO:163 | diablo isoform 1 precursor; second mitochondria-derived activator of caspase; direct IAP-binding protein with low pI; mitochondrial Smac protein |
| 165 | NP_063940 | SEQ ID NO:163 | diablo isoform 1 precursor; second mitochondria-derived activator of caspase; direct IAP-binding protein with low pI; mitochondrial Smac protein |
| 420 | NP_002961 | SEQ ID NO:164 | spermidine/spermine N1-acetyltransferase |
| 603 | NP_002961 | SEQ ID NO:164 | spermidine/spermine N1-acetyltransferase |
| 400 | NP_003921 | SEQ ID NO:165 | src family associated phosphoprotein 2; src kinase-associated phosphoprotein of 55-related protein; src-associated adaptor protein; Fyn-associated phosphoprotein SKAP55 homologue; Pyk2/RAFTK-associated protein |
| 517 | NP_003921 | SEQ ID NO:165 | src family associated phosphoprotein 2; src kinase-associated phosphoprotein of 55-related protein; src-associated adaptor protein; Fyn-associated phosphoprotein SKAP55 homologue; Pyk2/RAFTK-associated protein |
| 287 | AAH00870 | SEQ ID NO:166 | timeless-interacting protein; tipin |
| 351 | NP_060328 | SEQ ID NO:167 | timeless-interacting protein; tipin |
| 583 | NP_476516 | SEQ ID NO:168 | NATH; transcriptional coactivator tubedown-100 isoform 1; putative N-acetyltransferase; gastric cancer antigen Ga19 |
| 605 | NP_476516 | SEQ ID NO:168 | NATH; transcriptional coactivator tubedown-100 isoform 1; putative N-acetyltransferase; gastric cancer antigen Ga19 |
| 180 | NP_055518 | SEQ ID NO:169 | Vpr-binding protein (KIAA0800 protein) |
| 670 | XP_376232 | SEQ ID NO:170 | Vpr-binding protein (WD40 domain) |
| 5 | AAD38785 | SEQ ID NO:171 | unknown; LINE-1 reverse transcriptase related protein |
| 568 | AAC51264 | SEQ ID NO:172 | putative p150 (reverse transcriptase homolog-human retrotransposon L1) |
| 620 | AAG44794 | SEQ ID NO:173 | NPD017; NP_079139: hypothetical protein FLJ21174; AAL40909: B lymphocyte activation-related protein |
| 625 | AAG44794 | SEQ ID NO:173 | NPD017; NP_079139: hypothetical protein FLJ21174; AAL40909: B lymphocyte activation-related protein |

| Clone # | Accession # | Sequence Identifier | Gene Name |
|---|---|---|---|
| 88 | NP_000480 | SEQ ID NO:174 | transcriptional regulator ATRX isoform 1; DNA dependent ATPase and helicase (RAD54 (*S. cerevisiae*) homolog) |
| 146 | NP_005373 | SEQ ID NO:175 | neurofilament 3 (NEF3; 150 kDa medium) |
| 208 | CAC44371 | SEQ ID NO:176 | WDR9 protein |
| 241 | Q8IZQ5 | SEQ ID NO:177 | Selenoprotein H |
| 316 | NP_009066 | SEQ ID NO:178 | zinc finger protein 79 |
| 386 | XP_088636 | SEQ ID NO:179 | cylicin, basic protein of sperm head cytoskeleton 1 |
| 683 | AAQ09531 | SEQ ID NO:180 | potential extracellular protein |
| 71 | NP_659483 | SEQ ID NO:181 | calreticulin 3; calreticulin 2 (BAB71655: unnamed protein product) |

-continued

| Clone # | Accession # | Sequence Identifier | Gene Name |
|---|---|---|---|
| 140 | NP_659483 | SEQ ID NO:181 | calreticulin 3; calreticulin 2 (BAB71655: unnamed protein product) |
| 226 | NP_659483 | SEQ ID NO:181 | calreticulin 3; calreticulin 2 (BAB71655: unnamed protein product) |
| 83 | AAP44471 | SEQ ID NO:182 | heat shock protein (APG-1) |
| 576 | NP_002145 | SEQ ID NO:183 | heat shock 70 kDa protein 4 isoform a (APG-2) |
| 123 (173) | NP_150638 | SEQ ID NO:184 | T-cell activation protein (PGR1, structural constituent of ribosome) |
| 577 | NP_150638 | SEQ ID NO:184 | T-cell activation protein (PGR1, structural constituent of ribosome) |

| Clone # | Accession # | Sequence Identifier | Gene Name |
|---|---|---|---|
| 7 | NP_689547 | SEQ ID NO:185 | FLJ25005 protein (unnamed) |
| 14 | AAL57218 | SEQ ID NO:186 | FNP001 (ATPase family, AAA domain containing 1) |
| 19 | AAH02725 | SEQ ID NO:187 | ZCWPW1 protein |
| 24 | Q8IYR0 | SEQ ID NO:188 | C6orf165 |
| 25 | NP_689547 | SEQ ID NO:185 | FLJ25005 protein (unnamed) |
| 29 | XP_376556 | SEQ ID NO:189 | chromosome 6 open reading frame 70 |
| 33 | NP_689936 | SEQ ID NO:190 | hypothetical protein FLJ38159 |
| 34 | NP_689936 | SEQ ID NO:190 | hypothetical protein FLJ38159 |
| 36 | XP_376556 | SEQ ID NO:189 | chromosome 6 open reading frame 70 |
| 38 | XP_377694 | SEQ ID NO:191 | hypothetical protein |
| 43 | Q8IYR0 | SEQ ID NO:188 | C6orf165 |
| 49 | AAH26075 | SEQ ID NO:192 | Hypothetical protein MGC26598 |
| 72 | AAL77003 | SEQ ID NO:193 | unknown |
| 73 | NP_620167 | SEQ ID NO:194 | hypothetical protein BC019250 |
| 80 | NP_055605 | SEQ ID NO:195 | KIAA0555 |
| 115 | XP_371028 | SEQ ID NO:196 | hypothetical protein |
| 126 | AAH28610 | SEQ ID NO:205 | Unknown (protein for IMAGE: 5269996) |
| 127 | XP_377694 | SEQ ID NO:191 | hypothetical protein |
| 128 | BAB71574 | SEQ ID NO:197 | unnamed (Q8TCB7: Methyltransferase-like protein 4) (NP_689609: hypothetical protein MGC24132) |
| 131 | BAB71383 | SEQ ID NO:198 | unnamed |
| 147 | NP_079523 | SEQ ID NO:199 | hypothetical protein MGC5601; similar to acyl-CoA dehydrogenase (ACAD 10) |
| 158 | NP_079523 | SEQ ID NO:199 | hypothetical protein MGC5601; similar to acyl-CoA dehydrogenase (ACAD 10) |
| 167 | NP_113609 | SEQ ID NO:200 | hypothetical protein DKFZp434H0115 |
| 199 | NP_060387 | SEQ ID NO:201 | chromosome 14 open reading frame 10 |
| 203 | XP_371028 | SEQ ID NO:196 | hypothetical protein |
| 205 | AAH56888 | SEQ ID NO:202 | Unknown (protein for MGC: 65026) |
| 216 | NP_570140 | SEQ ID NO:203 | hypothetical telomeric protein (AAH34821: C10orf94 protein) |
| 221 | NP_056230 | SEQ ID NO:204 | DKFZP564B167 protein |
| 228 | AAH28610 | SEQ ID NO:205 | Unknown (protein for IMAGE: 5269996) |
| 242 | XP_372404 | SEQ ID NO:206 | similar to GTP-binding protein alpha-s subunit |
| 245 | XP_372404 | SEQ ID NO:206 | similar to GTP-binding protein alpha-s subunit |
| 293 | NP_057086 | SEQ ID NO:207 | CGI-49 protein |
| 298 | NP_653275 | SEQ ID NO:208 | hypothetical protein FLJ32871 |
| 368 | NP_115511 | SEQ ID NO:209 | chromosome 14 open reading frame 155 |
| 369 | NP_115511 | SEQ ID NO:209 | chromosome 14 open reading frame 155 |
| 387 | BAB14978 | SEQ ID NO:210 | unnamed |
| 397 | BAB14978 | SEQ ID NO:210 | unnamed |
| 413 | CAD38721 | SEQ ID NO:211 | hypothetical protein; NP_079057: chromosome 18 open reading frame 14 |
| 418 | NP_699207 | SEQ ID NO:212 | hypothetical protein FLJ90575 |
| 446 | NP_115511 | SEQ ID NO:209 | chromosome 14 open reading frame 155 |
| 548 | NP_919246 | SEQ ID NO:213 | protein containing single MORN motif in testis |
| 551 | XP_371540 | SEQ ID NO:214 | PREDICTED: ankyrin-related |
| 561 | NP_061829 | SEQ ID NO:215 | chromosome 9 open reading frame 9; Rsb66 homolog |
| 573 | NP_055448 | SEQ ID NO:216 | SH2 domain binding protein 1; TPR-containing, SH2-binding phosphoprotein (BAA09925: KIAA0155) |
| 574 | BAB14978 | SEQ ID NO:210 | unnamed |
| 581 | BAD18451 | SEQ ID NO:217 | unnamed |

-continued

| Clone # | Accession # | Sequence Identifier | Gene Name |
|---|---|---|---|
| 588 | AAH53533 | SEQ ID NO:218 | Hypothetical protein MGC61716 |
| 595 | NP_060387 | SEQ ID NO:201 | chromosome 14 open reading frame 10 |
| 612 | NP_689923 | SEQ ID NO:219 | chromosome 10 open reading frame 27 |
| 677 | BAA2548 | SEQ ID NO:220 | KIAA0555 |

Example 12

The Human MLF1 Gene Encodes a Suppressor of Oxidative DNA Damage

The human MLF1 gene was identified as a suppressor of oxidative DNA damage using the methods described. Further investigation using the bacterial antimutator assay showed that Mlf1 could specifically reduce GC→TA transversion mutations. Mlf1 reduced the spontaneous oxidative mutagenesis to levels similar to, or below that seen in a wild type, repair proficient strain when expressed in an fpg mutY double mutant strain, which exhibits a mutator phenotype. The MLF1 gene is of particular interest because it has been previously identified as a gene involved in a chromosomal translocation and implicated as a cause of leukemia (Raimondi, et al., 1989, Leukemia, 3:42-47). Also, it has recently been shown to be involved in cell cycle progression acting through a p53-dependent mechanism, and it has been suggested to function as a regulatory gene (Yoneda-Kato, 2005, EMBO J., 24:1739-1749). These results implicate MLF1 in repair or prevention of oxidative DNA damage. Combined with the results of Yoneda-Kato et al. (Yoneda-Kato, et al., 2005, EMBO J., 24:1739-1749), there is evidence that Mlf1 can act in a dual capacity, both preventing and/or repairing oxidative DNA damage and signaling cell cycle arrest, possibly in response to oxidative DNA damage.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (220 sequences)

SEQ ID NO: 1 - DNA, 384 bp, Homo sapiens
atgcctaaatcaaaggaacttgtttcttcaggctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaa

SEQ ID NO: 2 - protein, 127 aa, Homo sapiens
MPKSKELVSSGSSGSDSDSEVDKKLKRKKQVAPEKPVKKQKTGETSRALSSSKQSSSSRDDNMFQIGKMRYVSVRDFKGKVLIDIREYWMDPEGEMKPGRKGISLNPEQWSQLKEQISDIDDAVRKL

SEQ ID NO: 3 - protein, 13 aa, Unknown
  Synthetically generated peptide
MPSNSAPAHGTSS

SEQ ID NO: 4 - DNA, 43 bp, Artificial Sequence
  Primer
acgcgtcgacatgcaaaagacaggtgagacttcgagagctctg

SEQ ID NO: 5 - DNA, 30 bp, Artificial Sequence
  Primer
ccgctcgagtcatcttacaaattcctctgc

SEQ ID NO: 6 - DNA, 31 bp, Artificial Sequence
  Primer
gctctagatgtcatattacaacaggtatagg

SEQ ID NO: 7 - DNA, 30 bp, Artificial Sequence
  Primer
gcgaattcttattcttcttcacttatgtcg

SEQ ID NO: 8 - protein, 5 aa, Artificial Sequence
  Synthetically generated peptide
RRASV

SEQ ID NO: 9 - DNA, 50 bp, Artificial Sequence
  Synthetically generated oligonucleotide
gggcagacaacgtggcgctgttttttttttgtgtcctagcacagcgtatg

SEQ ID NO: 10 - DNA, 50 bp, Artificial Sequence
  Synthetically generated oligonucleotide
catacgctgtgctaggacaccccccccccccagcgccacgttgtctgccc

SEQ ID NO: 11 - protein, 667 aa, Homo sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 12 - protein, 650 aa, Homo sapiens
MASNMDREMILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQESLNQNFMLIITHREVQREYNLNFSGSSTIQEVKRNVYDLTSIPVRHQLWEGWPTSATDDSMCLAESGLSYPCHRLTVGRRSSPAQTREQSEEQITDVHMVSDSDGDDFEDATEFGVDDGEVFGMASSALRKSPMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQLDPNKSLLEVKLFPQETLFLEAKE

SEQ ID NO: 13 - protein, 925 aa, Homo sapiens
MDRSGFGEISSPVIREAEVTRTARKQSAQKRVLLQASQDENFGNTTPRNQVIPRTPSSFRQPFTPTSRSLLRQPDISCILGTGGKSPRLTQSSGFFGNLSMVTNLDDSNWAAAFSSQRSGLFTNTEPHSITEDVTISAVMLREDDPGEAASMSMFSDFLQSFLKHSSSTVFDLVEEYENICGSQVNILSKIVSRATPGLQKFSKTASMLWLLQQEMVTWRLLASLYRDRIQSALEEESVFAVTAVNASEKTVVEALFQRDSLVRQSQLVVDWLESIAKDEIGEFSDNIEFYAKSVYWENTLHTLKQRQLTSYVGSVRPLVTELDPDAPIRQKMPLDDLDREDEVRLLKYLFTLIRAGMTEEAQRLCKRCGQAWRAATLEGWKLYHDPNVNGGTELEPVEGNPYRRIWKISCWRMAEDELFNRYERAIYAALSGNLKQLLPVCDTWEDTVWAYFRVMVDSLVEQEIQTSVATLDETEELPREYLGANWTLEKVFEELQATDKKRVLEENQEHYHIVQKFLILGDIDGLMDEFSKWLSKSRNNLPGHLLRFMTHLILFFRTLGLQTKEEVSIEVLKTYIQLLIREKHTNLIAFYTCHLPQDLAVAQYALFLESVTEFEQRHHCLELAKEADLDVATITKTVVENIRKKDNGEFSHHDLAPALDTGTTEEDRLKIDVIDWLVFDPAQRAEALKQGNAIMRKFLASKKHEAAKEVFVKIPQDSIAEIYNQCEEQGMESPLPAEDDNAIREHLCIRAYLEAHETFNEWFKHMNSVPQKPALIPQPTFTEKVAHEHKEKKYEMDFGIWKGHLDALTADVKEKMYNVLLFVDGGWMVDVREDAKEDHERTHQMVLLRKLCLPMLCFLLHTILHSTGQYQECLQLADMVSSERHKLYLVFSKEELRKLLQKLRESSLMLLDQGLDPLGYEIQL

SEQ ID NO: 14 - protein, 125 aa, Homo sapiens [sequence omitted]

SEQ ID NO: 15 - protein, 805 aa, Homo sapiens [sequence omitted]

SEQ ID NO: 16 - protein, 556 aa, Homo sapiens
MAREKEMQEFTRSFFRGRPDLSTLTHSIVRRRYLAHSGRSHLEPEEKQALKRLVEEELLKMQVDEAASREDKLDLTKKGKRPPTPCSDPERKRFRFNSESESGSEASSPDYFGPPAKNGVAAEVSPAKEENPRRASKAVEESSDEERQRDLPAQRGEESSEEEEKGYKGKTRKKPVVKKQAPGKASVSRKQAREESEESEAEPVQRTAKKVEGNKGTKSLKESEQESEEEILAQKKEQREEEVEEEEKEEDEEKGDWKPRTRSNGRRKSAREERSCKQKSQAKRLLGDSDSEEEQKEAASSGDDSGRDREPPVQRKSEDRTQLKGGKRLSGSSEDEEDSGKGEPTAKGSRKMARLGSTSGEESDLEREVSDSEAGGGPQGERKNRSSKKSSRKGRTRSSSSSSDGSPEAKGGKAGSGRRGEDHPAVMRLKRYIRACGAHRNYKKLLGSCCSHKERLSILRAELEALGMKGTPSLGKCRALKEQREEAAEVASLDVANIISGSGRPRRRTAWNPLGEAAPPGELYRRTLDSDEERPRPAPPDWSHMRGIISSDGESN

SEQ ID NO: 17 - protein, 127 aa, Homo sapiens; identical to SEQ ID NO: 2

SEQ ID NO: 18 - protein, 391 aa, Homo sapiens
MDMASESVGGKILFATDDFFAPAENLIKSDSPCFKEHEYTEFGKWMDGWETRRKRIPGHDWCVLRLGIQGVIRGFDVDVSYFTGDYAPRVSIQAANLEEDKLPEIPERGTRTGAAATPEEFEAIAELKSDDWSYLVPMTELKPGNPASGHNYFLVNSQQRWTHIRLNIFPDGGIARLRVFGTGQKDWTATDPKEPADLVAIAFGGVCVGFSNAKFGHPNNIIGVGGAKSMADGWETARRLDRPPILENDENGILLVPGCEWAVFRLAHPGVITRIEIDTKYFEGNAPDSCKVDGCILTTQEEEAVIRQKWILPAHKWKPLLPVTKLSPNQSHLFDSLTLELQDVITHARLTIVPDGGVSRLRLRGFPSSICLLRPREKPMLKFSVSFKANP

SEQ ID NO: 19 - protein, 599 aa, Homo sapiens
MDGSRRVRATSVLPRYGPPCLFKGHLSTKSNAFCTDSSSLRLSTLQLVKNHMAVHYNKILSAKAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 20 - protein, 518 aa, Homo sapiens
MDFTEAYADTCSTVGLAAREGNVKVLRKLLKKGRSVDVADNRGWMPIHEAAYHNSVECLQMLINADSSENYIKMKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 21 - protein, 288 aa, Homo sapiens
MAATFFGEVVKAPCRAGTEDEEEEEEGRRETPEDREVRLQLARKREVRLLRRQTKTSLEVSLLEKYPCSKFIIAIGNNAVAFLSSFVMNSGVWEEVGCAKLWNEWCRTTDTTHLSSTEAFCVFYHLKSNPSVFLCQCSCYVAEDQQYQWLEKVFGSCPRKNMQITILTCRHVTDYKTSESTGSLPSPFLRALKTQNFKDSACCPLLEQPNIVHDLPAAVLSYCQVWKIPAILYLCYTDVMKLDLITVEAFKPILSTRSLKGLVKNIPQSTEILKKLMTTNEIQSNIYT

SEQ ID NO: 22 - protein, 1278 aa, Homo sapiens
MTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 23 - protein, 292 aa, Homo sapiens
MHGHGGYDSDFSDDEHCGESSKRKKRTVEDDLLLQKPFQKEKHGKVAHKQVAAELLDREEARNRRFHLIAMDAYQRHRKFINDYILYYGGKKEDFKRLGENDKTDLDVIRENHRFLWNEEDEMDMTWEKRLAKKYYDKLFKEYCIADLSKYKENKFGFRWRVEKEVISGKGQFFCGNKYCDKKEGLKSWEVNFGYIEHGEKRNALVKLRLCQECSIKLNFHHRRKEIKSKKRKDKTKKDCEESSHKKSRLSSAEEASKKKDKGHSSSKKSEDSLLKTYFVGLLSESNEKTYM

SEQ ID NO: 24 - protein, 447 aa, Homo sapiens
MDMGNQHPSISRLQEIQKEVKSVEQQVIGFSGLSDDKNYKKLERILTKQLFEIDSVDTEGKGDIQQARKRAAQETERLLKELEQNANHPHRIEIQNIFEEAQSLVREKIVPFYNGGNCVTDEFEEGIQDIILRLTHVKTGGKISLRKARYHTLTKIWAVQEIIEDCMKKQPSLPLSEDAHPSVAKINFVMCEVNKARGVLIALLMGVNNNETCRHLSCVLSGLIADLDALDVCGRTEIRNYRREVVEDINKLLKYLDLEEEADTTKAFDLRQNHSILKIEKVLKRMREIKNELLQAQNPSELYLSSKTELQGLIGQLDEVSLEKNPCIREARRRAVIEVQTLITYIDLKEALEKRKLFACEEHPSHKAVWNVLGNLSEIQGEVLSFDGNRTDKNYIRLEELLTKQLLALDAVDPQGEEKCKAARKQAVRLAQNILSYLDLKSDEWEY

SEQ ID NO: 25 - protein, 589 aa, Homo sapiens
MPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQVRSSLQLPAWGSDSLQDSWCTAAGTSRIDQDRSRMYDSLNMHSLENSLIDIMRAEHDPLKGRLSYPHPGTDNLLMLNGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 26 - protein, 426 aa, Homo sapiens
MSPAFRAMDVEPRAKGVLLEPFVHQVGGHSCVLRFNETTLCKPLVPREHQFYETLPAEMRKFTPQYKGVVSVRFEEDEDRNLCLIAYPLKGDHGIVDIVDNSDCEPKSKLLRWTTNKKHHVLETEKTPKDWVRQHRKEEKMKSHKLEEEFEWLKKSEVLYYTVEKKGNISSQLKHYNPWSMKCHQQQLQRMKENAKHRNQYKFILLENLTSRYEVPCVLDLKMGTRQHGDDASEEKAANQIRKCQQSTSAVIGVRVCGMQVYQAGSGQLMFMNKYHGRKLSVQGFKEALFQFFHNGRYLRRELLGPVLKKLTELKAVLERQESYRFYSSSLLVIYDGKERPEVVLDSDAEDLEDLSEESADESAGAYAYKPIGASSVDVRMIDFAHTTCRLYGEDTVVHEGQDAGYIFGLQSLIDIVTEISEESGE

SEQ ID NO: 27 - protein, 328 aa, Homo sapiens
MYTLHTKRVKAAARQMWTSNLSKVRQSLKNVYHKCKIRHQDSTGYPTVTSDDCNQDDDSYDGKMNLPVVLQDVKTAQVELFSQMTDIVHMIPKVQEKTDLYQKQMEVLETRMNVNEDKQCTTTKDILSMKEDIKALKKKVTELEIQNSCSTIHCLEILEGERGKEITELLYKLIQPATLKNTLASTDMEISSAEPEKVPSYPKSTDHLEKKTISPQMKTLKKRNHQNASRSFEKAKPNIYIYPDFSTWIKLTFVHGGKWTFFLSATKLEEFIQWLLSRPTILPEEPQVITQRYCPFTGPILSLTTICLSIFNNIYGFICSLKEEVTRL

SEQ ID NO: 28 - protein, 297 aa, Homo sapiens
MAELTALESLIEMGFPRGRAEKALALTGNQGIEAAMDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGLVPSAVLIVAKKCPS

SEQ ID NO: 29 - protein, 223 aa, Homo sapiens
MRDEIATTVFFVTRLVKKHDKLSKQQIEDFAEKLMTILFETYRSHWHSDCPSKGQAFRCIRINNNQNKDPILERACVESNVDFSHLGLPKEMTIWVDPFEVCCRYGEKNHPFTVASFKGRWEEWELYQQISYAVSRASSDVSSGTSCDEESCSKEPRVIPKVSNPKSIYQVENLKQPFQSWLQIPRKKNVVDGRVGLLGNTYHGSQKHPKCYRPAMHRLDRIL

SEQ ID NO: 30 - protein, 693 aa, Homo sapiens
MIAPLLCILSYNFNTFAILNVYSKLTMFCTTNSLPMDLLLKQGSLKQEVESFCYQIVSESNDQKVGILQSEDKQLQPSVSKKSEGELSRVKFISNSNKITFSKKPKRRKYDESYLSFGFTYFGNRDAPHAQCVLCKKILSNSSLAPSKLRRHLETKHAAYKDKDISFFKQHLDSPENNKPPTPKIVNTDNESATEASYNVSYHIALSGEAHTIGELLIKPCAKDVVMRMFDEQYSKKIDAVQLSNSTVARRIKDLAADIEEELVCRLKICDGFSLQLDESADVSGLAVLLVFVRYRFNKSIEEDLLLCESLQSNATGEEIFNCINSFMQKHEIEWEKCVDVCSDASRAVDGKIAEAVTLIKYVAPESTSSHCLLYRHALAVKIMPTSLKNVLDQAVQIINYIKARPHQSRLLKILCEEMGAQHTALLLNTEVRWLSRGKVLVRLFELRRELLVFMDSAFRLSDCLTNSSWLLRLAYLADIFTKLNEVNLSMQGKNVTVFTVFDKMSSLLRKLEFWASSVEEENFDCFPTLSDFLTEINSTVDKDICSAIVQHLRGLRATLLKYFPVTNDNNAWVRNPFTVTVKPASLVARDYESLIDLTSDSQVKQNFSELSLNDFWSSLIQEYPSIARRAVRVLLPFATMHLCETGFSYYAATKTKYRKRLDAAPHMRIRLSNITPNIKRICDKKTQKHCSH

SEQ ID NO: 31 - protein, 268 aa, Homo sapiens
MAVFADLDLRAGSDLKALRGLVETAAHLGYSVVAINHIVDFKEKKQEIEKPVAVSELFTTLPIVQGKSRPIKILTRLTIIVSDPSHCNVLRATSSRARLYDVVAVFPKTEKLFHIACTHLDVDLVCITVTEKLPFYFKRPPINVAIDRGLAFELVYSPAIKDSTMRRYTISSALNLMQICKGKNVIISSAAERPLEIRGPYDVANLGLLFGLSESDAKAAVSTNCRAALLHGETRKTAFGIISTVKKPRPSEGDEDCLPASKKAKCEG

SEQ ID NO: 32 - protein, 491 aa, Homo sapiens
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALELTRGVRPTPRVRAPATQQTRWKKDLAEDEEEEDEEDTEDGVSFQPYIEPPSFLGQEHQAPGHSEAGGVDSGRPRAPLVPSEGSSAWDSSDRSWASTVDSSWDRAGSSGYLAEKGPGQGPGGDGHQESLPPPEFSKDSGFLEELPEDNLSSWATWGTLPPEPNLVPGGPPVSLQTLTFCWESSPEEEEEARESEIEDSDAGSWGAESTQRTEDRGRTLGHYMAR

SEQ ID NO: 33 - protein, 1058 aa, Homo sapiens
MRRKGRCHRGSAARHPSSPCSVKHSPTRETLTYAQAQRMVEIEIEGRLHRISIFDPLEIILEDDLTAQEMSECNSNKENSERPPVCLRTKRHKNNRVKKKNEALPSAHGTPASASALPEPKVRIVEYSPPSAPRRPPVYYKFIEKSAEELDNEVEYDMDEEDYAWLEIVNEKRKGDCVPAVSQSMFEFLMDRFEKESHCENQKQGEQQSLIDEDAVCCICMDGECQNSNVILFCDMCNLAVHQECYGVPYIPEGQWLCRHCLQSRARPADCVLCPNKGGAFKKTDDDRWGHVVCALWIPEVGFANTVFIEPIDGVRNIPPARWKLTCYLCKQKGVGACIQCHKANCYTAFHVTCAQKAGLYMKMEPVKELTGGGTTFSVRKTAYCDVHTPPGCTRRPLNIYGDVEMKNGVCRKESSVKTVRSTSKVRKKAKKAKKALAEPCAVLPTVCAPYIPPQRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPEAGEEVLPRLETLLQPRKRSRSTCGDSEVEEESPGKRLDAGLTNGFGGARSEQEPGGGLGRKATPRRRCASESSISSSNSPLCDSSFNAPKCGRGKPALVRRHTLEDRSELISCIENGNYAKAARIAAEVGQSSMWISTDAAASVLEPLKVVWAKCSGYPSYPALIIDPKMPRVPGHHNGVTIPAPPLDVLKIGEHMQTKSDEKLFLVLFFDNKRSWQWLPKSKMVPLGIDETIDKLKMMEGRNSSIRKAVRIAFDRAMNHLSRVHGEPTSDLSDID

SEQ ID NO: 34 - protein, 584 aa, Homo sapiens
MVAEVCSMPTASTVKKPFDLRSKMGKWCHHRFPCCRGSGKSNMGTSGDHDDSFMKMLRSKMGKCCRHCFPCCRGSGTSNVGTSGDHENSFMKMLRSKMGKWCCHCFPCCRGSGKSNVGAWGDYDHSAFMEPRYHIRREDLDKLHRAAWWGKVPRKDLIVMLRDTDMNKRDKEKRTALHLASANGNSEVVQLLLDRRCQLNVLDNKKRTALIKAIQCQEDECVLMLLEHGADRNIPDEYGNTALHYAIYNEDKLMAKALLLYGADIESKNKCGLTPLLLGVHEQKQQVVKFLIKKKANLNVLDRYGRTALILAVCCGSASIVNLLLEQNVDVSSQDLSGQTAREYAVSSHHHVICELLSDYKEKQMLKISSENSNPEQDLKLTSEEESQRLKVSENSQPEKMSQEPEINKDCDREVEEEIKKHGSNPVGLPENLTNGASAGNGDDGLIPQRRSRKPENQQFPDTENEEYHSDEQNDTRKQLSEEQNTGISQDEILTNKQKQIEVAEQKMNSELSLSHKKEEDLLRENSVLQEEIAMLRLELDETKHQNQLRENKILEEIESVKEKTDKLLRAMQLNEEALTKTNI

SEQ ID NO: 35 - protein, 230 aa, Homo sapiens
MEGQRWLPLEANPEVTNQFLKQLGLHPNWQFVDVYGMDPELLSMVPRPVCAVLLLFPITEKYEVFRTEEEEKIKSQGQDVTSSVYFMKQTISNACGTIGLIHAIANNKDKMHFESGSTLKKFLEESVSMSPEERARYLENYDAIRVTHETSAHEGQTEAPSIDEKVDLHFIALVHVDGHLYELDGRKPFPINHGETSDETLLEDAIEVCKKFMERDPDELRFNAIALSAA

SEQ ID NO: 36 - protein, 351 aa, Homo sapiens
MEAFALGPARRGRRRTRAAGSLLSRAAILLFISAFLVRVPSSVGHLVRLPRAFRLTKDSVKIVGSTSFPVKAYVMLHQKSPHVLCVTQQLRNAELIDPSFQWYGPKGKVVSVENRTAQITSTGSLVFQNFEESMSGIYTCFLEYKPTVEEIVKRLQLKYAIYAYREPHYYYQFTARYHAAPCNSIYNISFEKKLLQILSKLLLDLSCEISLLKSECHRVKMQRAGLQNELFFAFSVSSLDTEKGPKRCTDHNCEPYKRLFKAKNLIERFFNQQVEILGRRAEQLPQIYYIEGTLQMVWINRCFPGYGMNVQQHPKCPECCVICSPGSYNPRDGIHCLQCNSSLVYGAKTCL

SEQ ID NO: 37 - protein, 543 aa, Homo sapiens
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 38 - protein, 435 aa, Homo sapiens
MLLGGPPRSPRSGTSPKGPWSSTGHVQFGKSPQTWPRRTRPRSPEPAAPSGVRGSTWTRRRDSPRRAGPTALSRYVGHLWMGRRPPSPEARGPVPRSSAASRARRSLASPGISPGPLTATIGGAVAGGGPRQGRAEAHKEVFPGQRVGKMAAPMELFCWSGGWGLPSVDLDSLAVLTYARFTGAPLKVHKISNPWQSPSGTLPALRTSHGEVISVPHKIITHLRKEVHTFWIDTKNYVEVTRKWYAEAMPFPLNFFLPGRMQRQYMERLQLLTGEHRPEDEEELEKELYREARECLTLLSQRLGSQKFFFGDAPASLDAFVFSYLALLLQAKLPSGKLQVHLRGLHNLCAYCTHILSLYFPWDGAEVPPQRQTPAGPETEEEPYRRRNQILSVLAGLAAMVGYALLSGIVSIQRATPARAPGTRTLGMAEEDEEE

SEQ ID NO: 39 - protein, 854 aa, Homo sapiens
MMAYSDTTMMSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISPRTPASKIASEMAYEAVELTAAEMRGTGEESREGGQKSFLYSELSNKSKSGDKQMSQRESKEFADSISKGLMVYANQVASDMMVSLMKTLKVHSSGKPIPASVVLKRVLLRHTKEIVSDLIDSCMKNLHNITGVLMTDSDFVSAVKRNLFNQWKQNATDIMEAMLKRLVSALIGEEKETKSQSLSYASLKAGSHDPKCRNQSLEFSTMKAEMKERDKGKMKSDPCKSLTSAEKVGEHILKEGLTIWNQKQGNSCKVATKACSNKDEKGEKINASTDSLAKDLIVSALKLIQYHLTQQTKGKDTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 40 - protein, 367 aa, Homo sapiens
MSSTLAKIAEIEAEMARTQKNKATAHHLGLLKARLAKLRRELITPKGGGGGGPGEGFDVAKTGDARIGFVGFPSVGKSTLLSNLAGVYSEVAAYEFTTLTTVPGVIRYKGAKIQLLDLPGIIEGAKDGKGRGRQVIAVARTCNLILIVLDVLKPLGHKKIIENELEGFGIRLNSKPPNIGFKKKDKGGINLTATCPQSELDAETVKSILAEYKIHNADVTLRSDATADDLIDVVEGNRVYIPCIYVLNKIDQISIEELDIIYKVPHCVPISAHHRWNFDDLLEKIWDYLKLVRIYTKPKGQLPDYTSPVVLPYSRTTVEDFCMKIHKNLIKEFKYALVWGLSVKHNPQKVGKDHTLEDEDVIQIVKK

SEQ ID NO: 41 - protein, 2230 aa, Homo sapiens
MFKKLKQKISEEQQQLQQALAPAQASSNSSTPTRMRSRTSSFTEQLDEGTPNRESGDTQSFAQKLQLRVPSVESLFRSPIKESLFRSSSKESLVRTSSRESLNRLDLDSSTASFDPPSDMDSEAEDLVGNSDSLNKEQLIQRLRRMERSLSSYRGKYSELVTAYQMLQREKKKLQGILSQSQDKSLRRIAELREELQMDQQAKKHLQEEFDASLEEKDQYISVLQTQVSLLKQRLRNGPMNVDVLKPLPQLEPQAEVFTKEENPESDGEPVVEDGTSVKTLETLQQRVKRQENLLKRCKETIQSHKEQCTLLTSEKEALQEQLDERLQELEKIKDLHMAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQIKTIEKTSEEERISLQQELSRVKQEVVDVMKKSSEEQIAKLQKLHEKELARKEQELTKKLQTREREFQEQMKVALEKSQSEYLKISQEKEQQESLALEELELQKKAILTESENKLRDLQQEAETYRTRILELESSLEKSLQENKNQSKDLAVHLEAEKNKHNKEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETNQKEQIESLTEVHRRELNDVISIWEKKLNQQAEELQEIHEIQLQEKEQEVAELKQKILLFGCEKEEMNKEITWLKEEGVKQDTTLNELQEQLKQKSAHVNSLAQDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMFTSPRSGIF

SEQ ID NO: 42 - protein, 503 aa, Homo sapiens
MSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 43 - protein, 393 aa, Homo sapiens
MMLRGNLKQVRIEKNPARLRALESAVGESEPAAAAAMALALAGEPAPPAPAPPEDHPDEEMGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKLMQKTQQYHKEREQPPRFAQPGTFEFEYASRWKALDEMEKQQREQVDRNIREAKEKLEAEMEAARHEHQLMLMRQDLMRRQEELRRLEELRNQELQKRKQIQLRHEEEHRRREEEMIRHREQEELRRQQEGFKPNYMENGDKRKCG

SEQ ID NO: 44 - protein, 733 aa, Homo sapiens
MENMAEEELLPLEKEEVEVAQVQVPTPARDSAGVPAPAPDSALDSAPTPASAPAPAPALAQAPALSPSLASAPEEAKSKRHISIQRQLADLENLAFVTDGNFDSASSLNSDNLDAGNRQACPLCPKEKFRACNSHKLRRHLQNLHWKVSVEFEGYRMCICHLPCRPVKPNIIGEQITSKMGAHYHCIICSATITRRTDMLGHVRRHMNKGETKSSYIAASTAKPPKEILKEADTDVQVCPNYSIPQKTDSYFNPKMKLNRQLIFCTLAALAEERKPLECLDAFGATGIMGLQWAKHLGNAVKVTINDLNENSVTLIQENCHLNKLKVVVDSKEKEKSDDILEEGEKNLGNIKVTKMDANVLMHLRSFDFIHLDPFGTSVNYLDSAFRNIRNLGIVSVTSTDISSLYAKAQHVARRHYGCNIVRTEYYKELAARIVVAAVARAAARCNKGIEVLFAVALEHFVLVVVRVLRGPTSADETAKKIQYLIHCQWCEERIFQKDGNMVEENPYRQLPCNCHGSMPGKTAIELGPLWSSSLFNTGFLKRMLFESLHHGLDDIQTLIKTLIFESECTPQSQFSIHASSNVNKQEENGVFIKTTDDTTTDNYIAQGKRKSNEMITNLGKKQKTDVSTEHPPFYYNIHRHSIKGMNMPKLKKFLCYLSQAGFRVSRTHFDPMGVRTDAPLMQFKSILLKYSTPTYTGGQSESHVQSASEDTVTERVEMSVNDKAEASGCRRW

SEQ ID NO: 45 - protein, 480 aa, Homo sapiens
LSSAARRRLWGFSESLLIRGAAGRSLYFGENRLRSTQAATQVVLNVPETRVTCLESGLRVASEDSGLSTCTVGLWIDAGSRYENEKNNGTAHFPEHMAFKGTKKRSQLDLELEIENMGAHLNAYTSREQTVYYAKAFSKDLPRAVEILADIIQNSTLGEAEIERERGVILREMQEVETNLQEVVFDYLHATAYQNTALGRTILGPTENIKSISRKDLVDYITTHYKGPRIVLAAAGGVSHDELLDLAKFHFGDSLCTHKGEIPALPPCKFTGSEIRVRDDKMPLAHLAIAVEAVGWAHPDTICLMVANTLIGNWDRSFGGGMNLSSKLAQLTCHGNLCHSFQSFNTSYTDTGLWGLYMVCESSTVADMLHVVQKEWMRLCTSVTESEVARARNLLKTNMLLQLDGSTPICEDIGRQMLCYNRRIPIPELEARIDAVNAETIREVCTKYIYNRSPAIAAVGPIKQLPDFKQIRSNMCWLRD

SEQ ID NO: 46 - protein, 395 aa, Homo sapiens
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKHLAEEKPDGLINEATRQVALADAILINKTDLVPEEDVKKLRATIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTHFKEDQVCT

SEQ ID NO: 47 - protein, 353 aa, Homo sapiens
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLMELFPANKQSVEHFTKYFTEAGLKELSEYVRNQQTIGARKELQKELQEQMSRGDPFKDIILYVKEEMKKNNIHFMKAFQKIVVLFYKAEVLSEEPILKWYKDAHVAKGKSVFLEQMKKFVEWLKNAEEESESEAEEGD

SEQ ID NO: 48 - protein, 219 aa, Homo sapiens
MSGLSGPPARRGPFPLALLLLFLLGPRLVLAISFHLPINSRKCLREEIHKDLLVTGAYEISDQSGGAGGLRSHLKITDSAGHILYSKEDATKGKFAFTTEDYDMFEVCFESKGTGRIPDQLVILDMKHGVEAKNYEEIAKVEKLKPLEVELRRLEDLSESIVNDFAYMKKREEEMRDTNESTNTRVLYFSIFSMFCLIGLATWQVFYLRRFFKAKKLIE

SEQ ID NO: 49 - protein, 673 aa, Homo sapiens [sequence omitted]

SEQ ID NO: 50 - protein, 550 aa, Homo sapiens
PRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPEGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPNRKMATNFLAHEKIWFDKFKYDDAERRFYEQMNGPVAGASRQSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 51 - protein, 760 aa, Homo sapiens
MAGQQFQYDDSGNTFFYFLTSFVGLIVIPATYYLWPRDQNAEQIRLKNIRKVYGRCMWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEETNRDSQSEKDDGSDRDSDREQDEKQNKDDEAEWQELQQSIQRKERALLETKSKITHPVYSLYFPEEKQEWWWLYIADRKEQTLISMPYHVCTLKDTEEVELKFPAPGKPGNYQYTVFLRSDSYMGLDQIKPLKLEVHEAKPVPENHPQWDTAIEGDEDQEDSEGFEDSFEEEEEEEEDDD

SEQ ID NO: 52 - protein, 360 aa, Homo sapiens
MAAERGAGQQQSQEMMEVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 53 - protein, 182 aa, Homo sapiens
IHIGEKPYKCNECGKAFCHKSALIVHQRTHTQEKPYKCNECGKSFCVKSGLIFHERKHTGEKPYECNECGKFFRHKSSLTVHHRAHTGEKSCQCNECGKIFYRKSELAQHQRSHTGEKPYECNTCRKTFSQKSNLIVHQRRHIGENLMNEMDIRNFQPQVSLHNASEYSHCGESPDDILNVQ

SEQ ID NO: 54 - protein, 310 aa, Homo sapiens
MLAPAAGEGPGVDLAAKAQVWLEQVCAHLGLGVQEPHPGERAAFVAYALAFPRAFQGLLDTYSVWRSGLPNFLAVALALGELGYRAVGVRLDSGDLLQQAQEIRKVFRAAAAQFQVPWLESVLIVVSNNIDEEALARLAQEGSEVNVIGIGTSVVTCPQQPSLGGVYKLVAVGGQPRMKLTEDPEKQTLPGSKAAFRLLGSDGSPLMDMLQLAEEPVPQAGQELRVWPPGAQEPCTVRPAQVEPLLRLCLQQGQLCEPLPSLAESRALAQLSLSRLSPEHRRLRSPAQYQVVLSERLQALVNSLCAGQSP

SEQ ID NO: 55 - protein, 188 aa, Homo sapiens
MSSLEISSSCFSLETKLPLSPPLVEDSAFEPSRKDMDEVEEKSKDVINFTAEKLSVDEVSQLVISPLCGAISLFVGTTRNNFEGKKVISLEYEAYLPMAENEVRKICSDIRQKWPVKHIAVFHRLGLVPVSEASIIIAVSSAHRAASLEAVSYAIDTLKAKVPIWKKEIYEESSTWKGNKECFWASNS

SEQ ID NO: 56 - protein, 964 aa, Homo sapiens
MDEQSVESIAEVFRCFICMEKLRDARLCPHCSKLCCFSCIRRWLTEQRAQCPHCRAPLQLRELVNCRWAEEVTQQLDTLQLCSLTKHEENEKDKCENHHEKLSVFCWTCKKCICHQCALWGGMHGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQLRSCSKSELISKSSEILMMFQQVHRKPMASFVTTPVPPDFTSELVPSYDSATFVLENFSTLRQRADPVYSPPLQVSGLCWRLKVYPDGNGVVRGYYLSVFLELSAGLPETSKYEYRVEMVHQSCNDPTKNIIREFASDFEVGECWGYNRFFRLDLLANEGYLNPQNDTVILRFQVRSPTFFQKSRDQHWYITQLEAAQTSYIQQINNLKERLTIELSRTQKSRDLSPPDNHLSPQNDDALETRAKKSACSDMLLEGGPTTASVREAKEDEEDEEKIQNEDYHHELSDGDLDLDLVYEDEVNQLDGSSSSASSTATSNTEENDIDEETMSGENDVEYNNMELEEGELMEDAAAAGPAGSSHGYVGSSSRISRRTHLCSAATSSLLDIDPLILIHLLDLKDRSSIENLWGLQPRPPASLLQPTASYSRKDKDQRKQQAMWRVPSDLKMLKRLKTQMAEVRCMKTDVKNTLSEIKSSSAASGDMQTSLFSADQAALAACGTENSGRLQDLGMELLAKSSVANCYIRNSTNKKSNSPKPARSSVAGSLSLRRAVDPGENSRSKGDCQTLSEGSPGSSQSGSRHSSPRALIHGSIGDILPKTEDRQCKALDSDAVVVAVFSGLPAVEKRRKMVTLGANAKGGHLEGLQMTDLENNSETGELQPVLPEGASAAPEEGMSSDSDIECDTENEEQEEHTSVGGFHDSFMVMTQPPDEDTHSSFPDGEQIGPEDLSFNTDENSGR

SEQ ID NO: 57 - protein, 1749 aa, Homo sapiens
MHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKAVGWDNMAFIFLNRFLDLTDAIEEGTLDGLDHSDFQDTDIPFEVPLPAKQHVPEAEREEVRDWVLTVSMDQRLEQVLPRDERGAYEASLVAASTGVRALPCLITGYPILRNKIEFKRPGKAANKDNWNKFLMAIKTSHSPVCQDVLKFISQWCGGLPSTSFSFQ

SEQ ID NO: 58 - protein, 391 aa, Homo sapiens
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 59 - protein, 514 aa, Homo sapiens
MADSGLDKKSTKCPDCSSASQKDVLCVCSSKTRVPPVLVVEMSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 60 - protein, 1685 aa, Homo sapiens [sequence omitted]

SEQ ID NO: 61 - protein, 491 aa, Homo sapiens
MSLLMISENVKLAREYALLGNYDSAMVYYQGVLDQMNKYLYSVKDTYLQQKWQQVWQEINVEAKHVKDIMKTLESFKLDSTPLKAAQHDLPASEGEVWSMPVPVERRPSPGPRKRQSSQYSDPKSHGNRPSTTVRVHRSSAQNVHNDRGKAVRCREKKEQNKGREEKNKSPAAVTEPETNKFDSTGYDKDLVEALERDIISQNPNVRWDDIADLVEAKKLLKEAVVLPMWMPEFFKGIRRPWKGVLMVGPPGTGKTLLAKAVATECKTTFFNVSSSTLTSKYRGESEKLVRLLFEMARFYSPATIFIDEIDSICSRRGTSEEHEASRRVKAELLVQMDGVGGTSENDDPSKMVMVLAATNFPWDIDEALRRRLEKRIYIPLPSAKGREELLRISLRELELADDVDLASIAENMEGYSGADITNVCRDASLMAMRRRIEGLTPEEIRNLSKEEMHMPTTMEDFEMALKKVSKSVSAADIERYEKWIFEFGSC

SEQ ID NO: 62 - protein, 322 aa, Homo sapiens
MEGISNFKTPSKLSEKKKSVLCSTPTINIPASPFMQKLGFGTGVNVYLMKRSPRGLSHSPWAVKKINPICNDHYRSVYQKRLMDEAKILKSLHHPNIVGYRAFTEANDGSLCLAMEYGGEKSLNDLIEERYKASQDPFPAAIILKVALNMARGLKYLHQEKKLLHGDIKSSNVVIKGDFETIKICDVGVSLPLDENMTVTDPEACYIGTEPWKPKEAVEENGVITDKADIFAFGLTLWEMMTLSIPHINLSNDDDDEDKTFDESDFDDEAYYAALGTRPPINMEELDESYQKVIELFSVCTNEDPKDRPSAAHIVEALETDV

SEQ ID NO: 63 - protein, 305 aa, Homo sapiens
MSFLRITPSTHSSVSSGLLRLSIFLLLSFPDSNGKAIWTAHLNITFQVGNEITSELGESGVFGNHSPLERVSGVVALPEGWNQNACHPLTNFSRPKQADSWLALIERGGCTFTHKINVAAEKGANGVIIYNYQGTGSKVFPMSHQGTENIVAVMISNLKGMEILHSIQKGVYVTVIIEVGRMHMQWVSHYIMYLFTFLAATIAYFYLDCVWRLTPRVPNSFTRRRSQIKTDVKKAIDQLQLRVLKEGDEELDLNEDNCVVCFDTYKPQDVVRILTCKHFFHKACIDPWLLAHRTCPMCKCDILKT

SEQ ID NO: 64 - protein, 253 aa, Homo sapiens
MCNTPTYCDLGKAAKDVFNKGYGFGMVKIDLKTKSCSGVEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLSQNNFALGYKAADFQLHTHVNDGTEFGGSIYQKVNEKIETSINLAWTAGSNNTRFGIAAKYMLDCRTSLSAKVNNASLIGLGYTQTLRP

SEQ ID NO: 65 - protein, 481 aa, Homo sapiens
MRHSKRTHCPDWDSRESWGHESYRGSHKRKRRSHSSTQENRHCKPHHQFKESDCHYLEARSLNERDYRDRRYVDEYRNDYCEGYVPRHYHRDIESGYRIHCSKSSVRSRRSSPKRKRNRHCSSHQSRSKSHRRKRSRSIEDDEEGHLICQSGDVLRARYEIVDTLGEGAFGKVVECIDHGMDGMHVAVKIVKNVGRYREAARSEIQVLEHLNSTDPNSVFRCVQMLEWFDHHGHVCIVFELLGLSTYDFIKENSFLPFQIDHIRQMAYQICQSINFLHHNKLTHTDLKPENILFVKSDYVVKYNSKMKRDERTLKNTDIKVVDFGSATYDDEHHSTLVSTRHYRAPEVILALGWSQPCDVWSIGCILIEYYLGFTVFQTHDSKEHLAMMERILGPIPQHMIQKTRKRKYFHHNQLDWDEHSSAGRYVRRRCKPLKEFMLCHDEEHEKLFDLVRRMLEYDPTQRITLDEALQHPFFDLLKKK

SEQ ID NO: 66 - protein, 361 aa, Homo sapiens
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGCGKTLIAKATAKEAGCRFINLQPSTLTDKWYGESQKLAAAVFSLAIKLQPSIIFIDEIDSFLRNRSSSDHEATAMMKAQFMSLWDGLDTDHSCQVIVMGATNRPQDLDSAIMRRMPTRFHINQPALKQREAILKLILKNENVDRHVDLLEVAQETDGFSGSDLKEMCRDAALLCVREYVNSTSEESHDEDEIRPVQQQDLHRAIEKMKKSKDAAFQNVLTHVCLD

SEQ ID NO: 67 - protein, 919 aa, Homo sapiens
MWLAAAAPSLARRLLFLGPPPPPLLLLVFSRSSRRRLHSLGLAAMPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 68 - protein, 345 aa, Homo sapiens
MLAARLVCLRTLPSRVFHPAFTKASPVVKNSITKNQWLLTPSREYATKTRIGIRRGRTGQELKEAALEPSMEKIFKIDQMGRWFVAGGAAVGLGALCYYGLGLSNEIGAIEKAVIWPQYVKDRIHSTYMYLAGSIGLTALSAIAISRTPVLMNFMMRGSWVTIGVTFAAMVGAGMLVRSIPYDQSPGPKHLAWLLHSGVMGAVVAPLTILGGPLLIRAAWYTAGIVGGLSTVAMCAPSEKFLNMGAPLGVGLGLVFVSSLGSMFLPPTTVAGATLYSVAMYGGLVLFSMFLLYDTQKVIKRAEVSPMYGVQKYDPINSMLSIYMDTLNIFMRVATMLATGGNRKK

SEQ ID NO: 69 - protein, 259 aa, Homo sapiens
MNKLKSSQKDKVRQFMIFTQSSEKTAVSCLSQNDWKLDVATDNFFQNPELYIRESVKGSLDRKKLEQLYNRYKDPQDENKIGIDGIQQFCDDLALDPASISVLIIAWKFRAATQCEFSKQEFMDGMTELGCDSIEKLKAQIPKMEQELKEPGRFKDFYQFTFNFAKNPGQKGLDLEMAIAYWNLVLNGRFKFLDLWNKFLLEHHKRSIPKDTWNLLLDFSTMIADDMSNYDEEGAWPVLIDDFVEFARPQIAGTKSTTV

SEQ ID NO: 70 - protein, 268 aa, Homo sapiens
MFRMLNSSFEDDPFFSESILAHRENMRQMIRSFSEPFGRDLLSISDGRGRAHNRRGHNDGEDSLTHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 71 - protein, 521 aa, Homo sapiens
MFYTHVLMSKRGPLAKIWLAAHWEKKLTKAHVFECNLEITIEKILSPKVKIALRTSGHLLLGVVRIYNRKAKYLLADCSEAFLKMKMTFCPGLVDLPKENFEASYNAITLPEEFHDFDTQNMNAIDVSEHFTQNQSRPEEITLRENFDNDLIFQAESFGEESEILRRHSFFDDNILLNSSGPLIEHSSGSLTGERSLFYDSGDGFGDEGAAGEMIDNLLQDDQNILLEDMHLNREISLPSEPPNSLAVEPDNSECICVPENEKMNETILLSTEEEGFTLDPIDISDIAEKRKGKKRRLLIDPIKELSSKVIHKQLTSFADTLMVLELAPPTQRLMMWKKRGGVHTLLSTAAQDLIHAELKMLFTKCFLSSGFKLGRKMIQKESVREEVGNQNIVETSMMQEPNYQQELSKPQTWKDVIGGSQHSSHEDTNKNINSEESLSNEENIETERWNGRILQMLNRLRVADQGQAAAAATAEALRQAGPEWCEPAGLRRASGLSPRDTAHPTPYSDPQPHGHVPARK

SEQ ID NO: 72 - protein, 1097 aa, Homo sapiens
  VARIANT (1)...(1097): Xaa = Any Amino Acid
MAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQXSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSXNNMQRQLALEVIVTXSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEGTLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 73 - protein, 509 aa, Homo sapiens
MAAAAGMLLLGLLQAGGSVLGQAMEKVTGGNLLSMLLIACAFTLSLVYLIRLAAGHLVQLPAGVKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 74 - protein, 55 aa, Homo sapiens
MSTSRKLKSHGMRRSKSRSPHKGVKRGGSKRKYRKGNLKSRKRGDDANRNYRSHL

SEQ ID NO: 75 - protein, 484 aa, Homo sapiens [sequence omitted]

SEQ ID NO: 76 - protein, 412 aa, Homo sapiens
MSGYQRRPGATPLSRARSLAIPDAPAFYERRSCLPQLNCERPHGRDLDSPFFGIRPAFMCYVPSPVLASVGDTDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 77 - protein, 144 aa, Homo sapiens
MPKVKRSRKAPPDGWELIEPTLDELDQKMREAETEPHEGKRKVESLWPIFRIHHQKTRYIFDLFYKRKAISRELYEYCIKEGYADKNLIAKWKKQGYENLCCLRCIQTRDTNFGTNCICRVPKSKLEVGRIIECTHCGCRGCSG

SEQ ID NO: 78 - protein, 529 aa, Homo sapiens
MLVLFETSVGYAIFKVLNEKKLQEVDSLWKEFETPEKANKIVKLKHFEKFQDTAEALAAFTALMEGKINKQLKKVLKKIVKEAHEPLAVADAKLGGVIKEKLNLSCIHSPVVNELMRGIRSQMDGLIPGVEPREMAAMCLGLAHSLSRYRLKFSADKVDTMIVQAISLLDDLDKELNNYIMRCREWYGWHFPELGKIISDNLTYCKCLQKVGDRKNYASAKLSELLPEEVEAEVKAAAEISMGTEVSEEDICNILHLCTQVIEISEYRTQLYEYLQNRMMAIAPNVTVMVGELVGARLIAHAGSLLNLAKHAASTVQILGAEKALFRALKSRRDTPKYGLIYHASLVGQTSPKHKGKISRMLAAKTVLAIRYDAFGEDSSSAMGVENRAKLEARLRTLEDRGIRKISGTGKALAKTEKYEHKSEVKTYDPSGDSTLPTCSKKRKIEQVDKEDEITEKKAKKAKIKVKVEEEEEEKVAEEEETSVKKKKKRGKKKHIKEEPLSEEEPCTSTAIASPEKKKKKKKKRENED

SEQ ID NO: 79 - protein, 305 aa, Homo sapiens
MTNQYGILFKQEQAHDDAIWSVAWGTNKKENSETVVTGSLDDLVKVWKWRDERLDLQWSLEGHQLGVVSVDISHTLPIAASSSLDAHIRLWDLENGKQIKSIDAGPVDAWTLAFSPDSQYLATGTHVGKVNIFGVESGKKEYSLDTRGKFILSIAYSPDGKYLASGAIDGIINIFDIATGKLLHTLEGHAMPIRSLTFSPDSQLLVTASDDGYIKIYDVQHANLAGTLSGHASWVLNVAFCPDDTHFVSSSSDKSVKVWDVGTRTCVHTFFDHQDQVWGVKYNGNGSKIVSVGDDQEIHIYDCPI

SEQ ID NO: 80 - protein, 350 aa, Homo sapiens
MAMRQTPLTCSGHTRPVVDLAFSGITPYGYFLISACKDGKPMLRQGDTGDWIGTFLGHKGAVWGATLNKDATKAATAAADFTAKVWDAVSGDELMTLAHKHIVKTVDFTQDSNYLLTGGQDKLLRIYDLNKPEAEPKEISGHTSGIKKALWCSEDKQILSADDKTVRLWDHATMTEVKSLNFNMSVSSMEYIPEGEILVITYGRSIAFHSAVSLDPIKSFEAPATINSASLHPEKEFLVAGGEDFKLYKYDYNSGEELESYKGHFGPIHCVRFSPDGELYASGSEDGTLRLWQTVVGKTYGLWKCVLPEEDSGELAKPKIGFPETTEEELEEIASENSDCIFPSAPDVKA

SEQ ID NO: 81 - protein, 217 aa, Homo sapiens
MSFRGGGRGGFNRGGGGGGFNRGGSSNHFRGGGGGGGGGNFRGGGRGGFGRGGGRGGFNKGQDQGPPERVVLLGEFLHPCEDDIVCKCTTDENKVPYFNAPVYLENKEQIGKVDEIFGQLRDFYFSVKLSENMKASSFKKLQKFYIDPYKLLPLQRFLPRPPGEKGPPRGGGRGGRGGGRGGGGRGGGRGGGFRGGRGGGGGGFRGGRGGGFRGRGH

SEQ ID NO: 82 - protein, 633 aa, Homo sapiens
MPSCGACTCGAAAVRLITSSLASAQRGISGGRIHMSVLGRLGTFETQILQRAPLRSFTETPAYFASKDGISKDGSGDGNKKSASEGSSKKSGSGNSGKGGNQLRCPKCGDLCTHVETFVSSTRFVKCEKCHHFFVVLSEADSKKSIIKEPESAAEAVKLAFQQKPPPPPKKIYNYLDKYVVGQSFAKKVLSVAVYNHYKRIYNNIPANLRQQAEVEKQTSLTPRELEIRRREDEYRFTKLLQIAGISPHGNALGASMQQQVNQQIPQEKRGGEVLDSSHDDIKLEKSNILLLGPTGSGKTLLAQTLAKCLDVPFAICDCTTLTQAGYVGEDIESVIAKLLQDANYNVEKAQQGIVFLDEVDKIGSVPGIHQLRDVGGEGVQQGLLKLLEGTIVNVPEKNSRKLRGETVQVDTTNILFVASGAFNGLDRIISRRKNEKYLGFGTPSNLGKGRRAAAAADLANRSGESNTHQDIEEKDRLLRHVEARDLIEFGMIPEFVGRLPVVVPLHSLDEKTLVQILTEPRNAVIPQYQALFSMDKCELNVTEDALKAIARLALERKTGARGLRSIMEKLLLEPMFEVPNSDIVCVEVDKEVVEGKKEPGYIRAPTKESSEEEYDSGVEEEGWPRQADAANS

SEQ ID NO: 83 - protein, 406 aa, Homo sapiens
MAAGAGAGSAPRWLRALSEPLSAAQLRRLEEHRYSAAGVSLLEPPLQLYWTWLLQWIPLWMAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTIPILEIKLKILPVLGFLGGVIFSCSNYFHVILHGGVGKNGSTIAGTSVLSPGLHIGLIIILAIMIYKKSATDVFEKHPCLYILMFGCVFAKVSQKLVVAHMTKSELYLQDTVFLGPGLLFLDQYFNNFIDEYVVLWMAMVISSFDMVIYFSALCLQISRHLHLNIFKTACHQAPEQVQVLSSKSHQNNMD

SEQ ID NO: 84 - protein, 141 aa, Homo sapiens
FLFLQRGGRADANMQIFVKTLTGKTITLEVEPSDTIENVKAKIQDKEGIPPDQQRLIFAGKQLEDGRTLSDYNIQKESTLHLVLRLRGGIIEPSLRQLAQKYNCDKMICRKCYARLHPRAVNCRKKKCGHTNNLRPKKKVK

SEQ ID NO: 85 - protein, 1802 aa, Homo sapiens
MAAAPTQIEAELYYLIARFLQSGPCNKSAQVLVQELEEHQLIPRRLDWEGKEHRRSFEDLVAANAHIPPDYLLKICERIGPLLDKEIPQSVPGVQTLLGVGRQSLLRDAKDCKSTLWNGSAFAALHRGRPPELPVNYVKPPNVVNITSARQLTGCSRFGHIFPSSAYQHIKMHKRILGHLSSVYCVAFDRSGRRIFTGSDDCLVKIWATDDGRLLATLRGHSAEISDMAVNYENTLIAAGSCDKVVRVWCLRTCAPVAVLQGHSASITSIQFCPSTKGTNRYLTSTGADGTICFWQWHVKTMKFRDRPVKFTERSRPGVQISCSSFSSGGMFITTGSTDHVIRIYYLGSEVPEKIAELESHTDKVVAVQFCNNGDSLRFVSGSRDGTARIWQYQQQEWKSIVLDMATKMTGNNLPSGEDKITKLKVTMVAWDRYDTTVITAVNNFLLKVWNSITGQLLHTLSGHDDEVFVLEAHPFDQRIILSAGHDGNIFIWDLDRGTKIRNYFNMIEGQGHGAVFDCKFSPDGNHFACTDSHGHLLLFGFGCSKYYEKIPDQMFFHTDYRPLIRDANNYVLDEQTQQAPHLMPPPFLVDVDGNPHPTKFQRLVPGRENCKDEQLIPQLGYVANGDGEVVEQVIGQQTNDQDESILDGIIRELQREQDLRLINEGDVPHLPVNRAYSVNGALRSPNMDISSSPNIRLRRHSSQIEGVRQMHNNAPRSQMATERDLMAWSRRVVVNELNNGVSRVQEECRTAKGDIEISLYTVEKKKKPSYTTQRNDYEPSCGRSLRRTQRKRQHTYQTRSNIEHNSQASCQNSGVQEDSDSSSEEDETVGTSDASVEDPVVEWQSESSSSDSSSEYSDWTADAGINLQPPKRQTRQTTRKICSSSDEENLKSLEERQKKPKQTRKKKGGLVSIAGEPNEEWFAPQWILDTIPRRSPFVPQMGDELIYFRQGHEAYVRAVRKSKIYSVNLQKQPWNKMDLREQEFVKIVGIKYEVGPPTLCCLKLAFLDPISGKMTGESFSIKYHDMPDVIDFLVLHQFYNEAKERNWQIGDRFRSIIDDAWWFGTVESQQPFQPEYPDSSFQCYSVHWDNNEREKMSPWDMEPIPEGTAFPDEVGAGVPVSQEELTALLYKPQEGEWGAHSRDEECERVIQGINHLLSLDFASPFAVPVDLSAYPLYCTVVAYPTDLNTIRRRLENRFYRRISALMWEVRYIEHNARTFNEPDSPIVKAAKIVTDVLLRFIGDQSCTDILDTYNKIKAEERNSTDAEEDTEIVDLDSDGPGTSSGRKVKCRGRRQSLKCNPDAWKKQCKELLSLIYEREDSEPFRQPADLLSYPGHQEQEGESSESVVPERQQDSSLSEDYQDVIDTPVDFSTVKETLEAGNYGSPLEFYKDVRQIFNNSKAYTSNKKSRIYSMMLRLSALFESHIKNIISEYKSAIQSQKRRRPRYRKRLRSSSSSLSSSGAPSPKGKQKQMKLQPKNDQNTSVSHARTSSPFSSPVSDAAEGLSLYLLDDEPDGPFSSSSFGGYSRSGNSHDPGKAKSFRNRVLPVKQDHSLDGPLTNGDGREPRTGIKRKLLSASEEDENMGGEDKEKKETKEKSHLSTSESGELGSSLSSESTCGSDSDSESTSRTDQDYVDGDHDYSKFIQTRPKRKLRKQHGNGKRNWKTRGTGGRGRWGRWGRWSRGGRGRGGRGRGSRGRGGGGTRGRGRGRGGRGASRGATRAKRARIADDEFDTMFSGRFSRLPRIKTRNQGRRTVLYNDDSDNDNFVSTEDPLNLGTSRSGRVRKMTEKARVSHLMGWNY

SEQ ID NO: 86 - protein, 699 aa, Homo sapiens [sequence omitted]

SEQ ID NO: 87 - protein, 728 aa, Homo sapiens
MEETQPPPQPKLPLCDSLMIWLQTFNTASPCQDVKQLTSGVAMAQVLHQIDAAWFNESWLSRIKEDVGDNWRIKASNVKKVLQGIMSYYHEFLGQQISEALIPDLNQITECSDPVELGRLLQLILGCAINCEKKQEHIQNIMTLEESVQHVVMTAIQELMSKEILSSPPNDAVGELEQQLKRALEELQEALAEKEELRQRCEELDMQVTTLQDEKNSLVSENEMMNEKLDQLDGSFDDPNTVVAKKYFHAQLQLEQLQEENFRLEAAKDDYRVHCEELEKQLIEFQHRNDELTSLAEETRALKDEIDVLRATSDKANKLESTVEIYRQKLQDLNDLRKQVKTLQETNMMYMHNTVSLEEELKKANAARTQLETYKRQVQDLHVKLSSESKRADTLAFEMKRLEEKHEALLKEKERLIEQRDTLKETNEELRCSQVQQDHLNQTDASATKSYENLAAEIMPVEYREVFIRLQHENKMLRLQQEGSENERIEELQEQLEQKHRKMNELETEQRLSKERIRELQQQIEDLQKSLQEQGSKSEGESSSKLKQKLEAHMEKLTEVHEELQKKQELIEDLQPDINQNVQKINELEAALQKKDEDMKAMEERYKMYLEKARNVIKTLDPKLNPASAEIMLLRKQLAEKERRIEILESECKVAKFRDYEEKLIVSAWYNKSLAFQKLGMESRLVSGGGACSDTGACTPARSFLAQQRHITNTRRNLSVKVPATTSD

SEQ ID NO: 88 - protein, 316 aa, Homo sapiens
MKIANNTVVTEFILLGLTQSQDIQLLVFVLILIFYLIILPGNFLIIFTIRSDPGLTAPLYLFLGNLAFLDASYSFIVAPRMLVDFLSEKKVISYRGCITQLFFLHFLGGGEGLLLVVMAFDRYIAICRPLHCSTVMNPRACYAMMLALWLGGFVHSIIQVVLILRLPFCGPNQLDNFFCDVRQVIKLACTDMFVVELLMVFNSGLMTLLCFLGLLASYAVILCHVRRAASEGKNKAMSTCTTRVIIILLMFGPAIFIYMCPFRALPADKMVSLFHTVIFPLMNPMIYTLRNQEVKTSMKRLLSRHVVCQVDFIIRN

SEQ ID NO: 89 - protein, 494 aa, Homo sapiens
MSTGTFVVSQPLNYRGGARVEPADASGTEKAFEPATGRVIATFTCSGEKEVNLAVQNAKAAFKIWSQKSGMERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLTNCRDDMTCVKEEIFGPVMSILSFDTEAEVLERANDTTFGLAAGVFTRDIQRAHRVVAELQAGTCFINNYNVSPVELPFGGYKKSGFGRENGRVTIEYYSQLKTVCVEMGDVESAF

SEQ ID NO: 90 - protein, 518 aa, Homo sapiens
MFLRAGLAALSPLLRSLRPSPVAAMSTGTFVVSQPLNYRGGARVEPADASGTEKAFEPATGRVIATFTCSGEKEVNLAVQNAKAAFKIWSQKSGMERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLTNCRDDMTCVKEEIFGPVMSILSFDTEAEVLERANDTTFGLAAGVFTRDIQRAHRVVAELQAGTCFINNYNVSPVELPFGGYKKSGFGRENGRVTIEYYSQLKTVCVEMGDVESAF

SEQ ID NO: 91 - protein, 337 aa, Homo sapiens
MKKMPLFSKSHKNPAEIVKILKDNLAILEKQDKKTDKASEEVSKSLQAMKEILCGTNEKEPPTEAVAQLAQELYSSGLLVTLIADLQLIDFEGKKDVTQIFNNILRRQIGTRSPTVEYISAHPHILFMLLKGYEAPQIALRCGIMLRECIRHEPLAKIILFSNQFRDFFKYVELSTFDIASDAFATFKDLLTRHKVLVADFLEQNYDTIFEDYEKLLQSENYVTKRQSLKLLGELILDRHNFAIMTKYISKPENLKLMMNLLRDKSPNIQFEAFHVFKVFVASPHKTQPIVEILLKNQPKLIEFLSSFQKERTDDEQFADEKNYLIKQIRDLKKTAP

SEQ ID NO: 92 - protein, 337 aa, Homo sapiens
MKKMPLFSKSHKNPAEIVKILKDNLAILEKQDKKTDKASEEVSKSLQAMKEILCGTNEKEPPTEAVAQLAQELYSSGLLVTLIADLQLIDFEEKKDVTQIFNNILRRQIGTRSPTVEYISAHPHILFMLLKGYEAPQIALRCGIMLRECIRHEPLAKIILFSNQFRDFFKYVELSTFDIASDAFATFKDLLTRHKVLVADFLEQNYDTIFEDYEKLLQSENYVTKRQSLKLLGELILDRHNFAIMTKYISKPENLKLMMNLLRDKSPNIQFEAFHVFKVFVASPHKTQPIVEILLKNQPKLIEFLSSFQKERTDDEQFADEKNYLIKQIRDLKKTAP

SEQ ID NO: 93 - protein, 3116 aa, Homo sapiens
MRSSKSKEVPLPNPRNSQSKDTVQDITTSWDALSQTKAALRHIENKLEVAPTSTAVCDSVMDTKKSSTSATRKISRKDGRYLDDSWVNAPISKSTKSRKEKSRSPLRATTLESNVKKNNRVEFREPLVSYREIHGAPSNFSSSHLESKHVYCVDVNEEKTESGNWMIGSREERNIRSCDFESSQSSVINDTVVRFLNDRPAIDALQNSECLIRMGASMRTEEEMPNRTKGSENNLKLSVNNMAHDTDPKALRLTDSSPSSTSTSNSQRLDILKRRQHDVKLEKLKERIRKQWEHSEETNGRGQKLGHIDHPVMVVNVDNSVTAKVRKVATAPPAPAYKGFNPSETKIRTPDGKVWQEAEFQNMSRELYRDLALHFADDISIKEKPAEKSKEKKVVKPVRKVQKVAQLSSTECRTGSSHLISTSSWRDGQKLVKKILGPAPRMEPKEQRTASSDRGGRERTAKSGGHIGRAESDPRLDVLHRHLQRNSERSRSKSRSENNIKKLASSLPDNKQEENTALNKDFLPIEIRGILDDLQLDSTAHTAKQDTVELQNQKSSAPVHAPRSHSPVKRKPDKITANEDPPVISKRRHYDTDEVRQYIVRQQEERKRKQNEEKKAQKEATEQKNKRLQELYRKQKEAFTKVKNVPPSEPSATRRLQETYSKLLLEKTLLEEPSHQHVTQETQAKPGYQPSGESDKENKVQERPPSASSSSDMSLSEPPQPLARKDLMESTWMQPERLSPQVHHSQPQPFAGTAGSLLSHLLSLEHVGILHKDFESILPTRKNHNMASRPLTFTPQPYVTSPAAYTDALLKPSASQYKSKLDRIEALKATAASLSSRIESEAKKLAGASINYGSAWNTEYDVQQAPQEDGPWTKAVTPPVKDDNEDVFSARIQKMLGSCVSHATFDDDLPGVGNLSEFKKLPEMIRPQSAISSFRVRSPGPKPEGLLAQLCKRQTDSSSSDMQACSQDKAKISLGSSIDSVSEGPLLSEGSLSEEEGDQDGQPLLKVAEILKEKEFCPGERNSYEPIKEFQKEAEKFLPLFGHIGGTQSKGPWEELAKGSPHSVINIFTKSYQLYGKGFEDKLDRGTSTSRPLNATATPLSGVSYEDDFVSSPGTGTSTEKKSTLEPHSTLSPQEDHSNRKSAYDPSSVDVTSQHSSGAQSAASSRSSTSSKGKKGKKEKTEWLDSFTGNVQNSLLDEEKAERGSHQGKKSGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKAQQQRHERDLALLKLKAEQEALESQRQLEETRNKAAQVHAESLQQVVQSQREVTEVLQEATCKIAAQQSETARLTTDAARQICEMAELTRTHISDAVVASGAPLAILYDHQRQHLPDFVKQLRTRTETDRKSPSVSLSQSKEGTLDSKHQKYSASYDSYSESSGYKNHDRRSSSGSSRQESPSVPSCKENEKKLNGEKIESSIDEQVQTAADDSLRSDSVPSLPDEKDSTSIATEYSLKFDESMTEDEIEEQSFRSLLPSESHRRFNMEKRRGHHDDSDEEASPEKTTLSTAKELNMPFSGGQDSFSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 94 - protein, 1150 aa, Homo sapiens [sequence omitted]

SEQ ID NO: 95 - protein, 1150 aa, Homo sapiens
MAQFGGQKNPPWATQFTATAVSQPAALGVQQPSLLGASPTIYTQQTALAAAGLTTQTPANYQLTQTAALQQQAAAAAAALQQQYSQPQQALYSVQQQLQQPQQTLLTQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISENMNLQFENQMNKTIRNLSTVMDEIHTVLKKDNVKNEDKDQKSKENGASV

SEQ ID NO: 96 - protein, 2325 aa, Homo sapiens
MKKGSQQKIFSKAKIPSSSHSPIPSSMSNMRSRSLSPLIGSETLPFHSGGQWCEQVEIADENNMLLDYQDHKGADSHAGVRYITEALIKKLTKQDNLALIKSLNLSLSKDGGKKFKYIENLEKCVKLEVLNLSYNLIGKIEKLDKLLKLRELNLSYNKISKIEGIENMCNLQKLNLAGNEIEHIPVWLGKKLKSLRVLNLKGNKISSLQDISKLKPLQDLISLILVENPVVTLPHYLQFTIFHLRSLESLEGQPVTTQDRQEAFERFSLEEVERLERDLEKKMIETEELKSKQTRFLEEIKNQDKLNKSLKEEAMLQKQSCEELKSDLNTKNELLKQKTIELTRACQKQYELEQELAFYKIDAKFEPLNYYPSEYAEIDKAPDESPYIGKSRYKRNMFATESYIIDSAQAVQIKKMEPDEQLRNDHMNLRGHTPLDTQLEDKEKKISAAQTRLSELHDEIEKAEQQILRATEEFKQLEEAIQLKKISEAGKDLLYKQLSGRLQLVNKLRQEALDLELQMEKQKQEIAGKQKEIKDLQIAIDSLDSKDPKHSHMKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 97 - protein, 2024 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNMPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNGKETKNRWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAGTTVNNLEETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 98 - protein, 2024 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRGALQGRQAALLALQHKADEAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSACLGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNVPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIHEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNRKETKNTWKNNCPFSADENYRPLAKTRQQNISMQRQENLRWVSELSYVEEKEQWQEQIQLKKQLDFSVSICQTLMQDQQTLSCLLQTLLTGPYSVMPSNVASPQVHFIMHQLNQCYTQLTWQQNNVQRLKQMLNELMRQRNQHPEKPGGKERGSSASHPPSPSLFCPFSFPTQPVNLFNIPGFTNFSSFAPGMNFSPLFPSNFGDFSQNISTPSEQQQPLARILSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPLQAKVFSRKNHEQLEKIIKCNRSTEISSETGSDFSMFEALQDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAGTTVNNLEETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVHWNEKPLVKMTKNNCPVKPSYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEMCEMQTEELAGNSETLKEPETVGAQSI

SEQ ID NO: 99 - protein, 729 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNTSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQSQLPNPSEASTTFPESHLRTPQMPPTTPSSSFFTKKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 100 - protein, 230 aa, Homo sapiens
MGQQISDQTQLVINKLPEKVAKHVTLVRESGSLTYEEFLGRVAELNDVTAKVASGQEKHLLFEVQPGSDSSAFWKVVVRVVCTKINKSSGIVEASRIMNLYQFIQLYKDITSQAAGVLAQSSTSEEPDENSSSVTSCQASLWMGRVKQLTDEEECCICMDGRADLILPCAHSFCQKCIDKWSDRHRNCPICRLQMTGANESWVVSDAPTEDDMANYILNMADEAGQPHRP

SEQ ID NO: 101 - protein, 189 aa, Homo sapiens
MVKETTYYDVLGVKPNATQEELKKAYRKLALKYHPDKNPNEGEKFKQISQAYEVLSDAKKRELYDKGGEQAIKEGGAGGGFGSPMDIFDMFFGGGGRMQRERRGKNVVHQLSVTLEDLYNGATRKLALQKNVICDKCEGRGGKKGAVECCPNCRGTGMQIRNSSDRTWNGSANSVCVHGVPGPWGADQS

SEQ ID NO: 102 - protein, 412 aa, Homo sapiens
MANVADTKLYDILGVPPGASENELKKAYRKLAKEYHPDKNPNAGDKFKEISFAYEVLSNPEKRELYDRYGEQGLREGSGGGGGMDDIFSHIFGGGLFGFMGNQSRSRNGRRRGEDMMHPLKVSLEDLYNGKTTKLQLSKNVLCSACSGQGGKSGAVQKCSACRGRGVRIMIRQLAPGMVQQMQSVCSDCNGEGEVINEKDRCKKCEGKKVIKEVKILEVHVDKGMKHGQRITFTGEADQAPGVEPGDIVLLLQEKEHEVFQRDGNDLHMTYKIGLVEALCGFQFTFKHLDGRQIVVKYPPGKVIEPGCVRVVRGEGMPQYRNPFEKGDLYIKFDVQFPENNWINPDKLSELEDLLPSRPEVPNIIGETEEVELQEFDSTRGSGGGQRREAYNDSSDEESSSHHGPGVQCAHQ

SEQ ID NO: 103 - protein, 531 aa, Homo sapiens
MAAVKTLNPKAEVARAQAALAVNISAARGLQDVLRTNLGPKGTMKMLVSGAGDIKLTKDGNVLLHEMQIQHPTASLIAKVATAQDDITGDGTTSNVLIIGELLKQADLYISEGLHPRIITEGFEAAKEKALQFLEEVKVSREMDRETLIDVARTSLRTKVHAELADVLTEAVVDSILAIKKQDEPIDLFMIEIMEMKHKSETDTSLIRGLVLDHGARHPDMKKRVEDAYILTCNVSLEYEKTEVNSGFFYKSAEEREKLVKAERKFIEDRVKKIIELKRKVCGDSDKGFVVINQKGIDPFSLDALSKEGIVALRRAKRRNMERLTLACGGVALNSFDDLSPDCLGHAGLVYEYTLGEEKFTFIEKCNNPRSVTLLIKGPNKHTLTQIKDAVRDGLRAVKNAIDDGCVVPGAGAVEVAMAEALIKHKPSVKGRAQLGVQAFADALLIIPKVLAQNSGFDLQETLVKIQAEHSESGQLVGVDLNTGEPMVAAEVGVWDNYCVKKQLLHSCTVIATNILLVDEIMRAGMSSLKG

SEQ ID NO: 104 - protein, 535 aa, Homo sapiens
MASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 105 - protein, 541 aa, Homo sapiens
MASMGTLAFDEYGRPFLIIKDQDRKSRLMGLEALKSHIMAAKAVANTMRTSLGPNGLDKMMVDKDGDVTVTNDGATILSMMDVDHQIAKLMVELSKSQDDEIGDGTTGVVVLAGALLEEAEQLLDRGIHPIRIADGYEQAARVAIEHLDKISDSVLVDIKDTEPLIQTAKTTLGSKVVNSCHRQMAEIAVNAVLTVADMERRDVDFELIKVEGKVGGRLEDTKLIKGVIVDKDFSHPQMPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 106 - protein, 530 aa, Homo sapiens [sequence omitted]

SEQ ID NO: 107 - protein, 535 aa, Homo sapiens [sequence omitted]

SEQ ID NO: 108 - protein, 556 aa, Homo sapiens
MEGPLSVFGDRSTGETIRSQNVMAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 109 - protein, 556 aa, Homo sapiens; identical to SEQ ID NO: 108

SEQ ID NO: 110 - protein, 248 aa, Homo sapiens
MAPKAAKGAKPEPAPAPPPPGAKPEEDKKDGKEPSDKPQKAVQDHKEPSDKPQKAVQPKHEVGTRRGCRRYRWELKDSNKEFWLLGHAEIKIRSLGCLIAAMILLSSLTVHPILRLIITMEISFFSFFILLYSFAIHRYIPFILWPISDLFNDLIACAFLVGAVVFAVRSRRSMNLHYLLAVILIGAAGVFAFIDVCLQRNHFRGKKAKKHMLVPPPGKEKGPQQGKGPEPAKPPEPGKPPGPAKGKK

SEQ ID NO: 111 - protein, 248 aa, Homo sapiens; identical to SEQ ID NO: 110

SEQ ID NO: 112 - protein, 648 aa, Homo sapiens
MSHHGGAPKASTWVVASRRSSTVSRAPERRPAEELNRTGPEGYSVGRGGRWRGTSRPPEDVAAGHEELPLCFALKSHFVGAVIGRGGSKIKNIQSTTNTTIQIIQEQPESLVKIFGSKAMQTKAKAVIDNFVKKLEENYNSECGIDTAFQPSVGKDGSTDNNVVAGDRPLIDWDQIREEGLKWQKTKWADLPPIKKNFYKESTATSAMSKVEADSWRKENFNITWDDLKDGEKRPIPNPTCTFDDAFQCYPEVMENIKKAGFQKPTPIQSQAWPIVLQGIDLIGVAQTGTGKTLCYLMPGFIHLVLQPSLKGQRNRPGMLVLTPTRELALQVEGECCKYSYKGLRSVCVYGGGNRDEQIEELKKGVDIIIATPGRLNDLQMSNFVNLKNITYLVLDEADKMLDMGFEPQIMKILLDVRPDRQTVMTSATWPHSVHRLAQSYLKEPMIVYVGTLDLVAVSSVKQNIIVTTEEEKWSHMQTFLQSMSSTDKVIVFVSRKAVADHLSSDLILGNISVESLHGDREQRDREKALENFKTGKVRILIATDLASRGLDVHDVTHVYNFDFPRNIEEYVHRIGRTGRAGRTGVSITTLTRNDWRVASELINILERANQSIPEELVSMAERFKAHQQKREMERKMERPQGRPKKFH

SEQ ID NO: 113 - protein, 478 aa, Homo sapiens
MATDSWALAVDEQEAAVKSMTNLQIKEEKVKADTNGIIKTSTTAEKTDEEEKEDRAAQSLLNKLIRSNLVDNTNQVEVLQRDPNSPLYSVKSFEELRLKPQLLQGVYAMGFNRPSKIQENALPMMLAEPPQNLIAQSQSGTGKTAAFVLAMLSRVEPSDRYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 114 - protein, 614 aa, Homo sapiens
MSGYSSDRDRGRDRGFGAPRFGGSRAGPLSGKKFGNPGEKLVKKKWNLDELPKFEKNFYQEHPDLARRTAQEVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETKRRCDELTRKMRRDGWPAMGIHGDKSQQERDWVLNEFKHGKAPILIATDVASRGLDVEDVKFVINYDYPNSSEDYIHRIGRTARSTKTGTAYTFFTPNNIKQVSDLISVLREANQAINPKLLQLVEDRGSGRSRGRGGMKDDRRDRYSAGKRGGFNTFRDRENYDRGYSSLLKRDFGAKTQNGVYSAANYTNGSFGSNFVSAGIQTSFRTGNPTGTYQNGYDSTQQYGSNVPNMHNGMNQQAYAYPATAAAPMIGYPMPTGYSQ

SEQ ID NO: 115 - protein, 408 aa, Homo sapiens
MSGGSADYNSREHGGPEGMDPDGVIESNWNEIVDNFDDMNLKESLLRGIYAYGFEKPSAIQQRAIIPCIKGYDVIAQAQSGTGKTATFAISILQQLEIEFKETQALVLAPTRELAQQIQKVILALGDYMGATCHACIGGTNVRNEMQKLQAEAPHIVVGTPGRVFDMLNRRYLSPKWIKMFVLDEADEMLSRGFKDQIYEIFQKLNTSIQVVLLSATMPTDVLEVTKKFMRDPIRILVKKEELTLEGIKQFYINVEREEWKLDTLCDLYETLTITQAVIFLNTRRKVDWLTEKMHARDFTVSALHGDMDQKERDVIMREFRSGSSRVLITTDLLARGIDVQQVSLVINYDLPTNRENYIHRIGRGGRFGRKGVAINFVTEEDKRILRDIETFYNTTVEEMPMNVADLI

SEQ ID NO: 116 - protein, 312 aa, Homo sapiens
MLTVLRSLPLFSRELLFPVLKIQKVILALGDYMGATCHACIGGTNVRNEMQKLQAEAPHIVVGTPGRVFDMLNRRYLSPKWIKMFVLDEADEMLSRGFKDQIYEIFQKLNTSIQVVLLSATMPTDVLEVTKKFMRDPIRILVKKEELTLEGIKQFYINVEREEWKLDTLCDLYETLTITQAVIFLNTRRKVDWLTEKMHARDFTVSALHGDMDQKERDVIMREFRSGSSRVLITTDLLARGIDVQQVSLVINYDLPTNRENYIHRIGRGGRFGRKGVAINFVTEEDKRILRDIETFYNTTVEEMPMNVADLI

SEQ ID NO: 117 - protein, 258 aa, Homo sapiens
MAAAAAAAGDSDSWDADAFSVEDPVRKVGGGGTAGGDRWEGEDEDEDVKDNWDDDDDEKKEEAEVKPEVKISEKKKIAEKIKEKERQQKKRQEEIKKRLEEPEEPKVLTPEEQLADKLRLKKLQEESDLELAKETFGVNNAVYGIDAMNPSSRDDFTEFGKLLKDKITQYEKSLYYASFLEVLVRDVCISLEIDDLKKITNSLTVLCSEKQKQEKQSKAKKKKKGVVPGGGLKATMKDDLADYGGYDGGYVQDYEDFM

SEQ ID NO: 118 - protein, 179 aa, Homo sapiens
MRDPIRILVKKEELTLEGIKQFYINVEREEWKLDTLCDLYETLTITQAVIFLNTRRKVDWLTEKMHARDFTVSALHGDMDQKERDVIMREFRSGSSRVLITTDLLARGIDVQQVSLVINYDLPTNRENYIHRIGRGGRFGRKGVAINFVTEEDKRILRDIETFYNTTVEEMPMNVADLI

SEQ ID NO: 119 - protein, 407 aa, Homo sapiens
MSGGSADYNREHGGPEGMDPDGVIESSWNEIVDNFDDMNLKESLLRGIYAYGFEKPSAIQQRAIIPCIKGYDVIAQAQSGTGKTATFAISILQQLEIEFKETQALVLAPTRELAQQIQKVILALGDYMGATCHACIGGTNVRNEMQKLQAEAPHIVVGTPGRVFDMLNRRYLSPKWIKMFVLDEADEMLSRGFKDQIYEIFQKLNTSIQVVLLSATMPTDVLEVTKKFMRDPIRILVKKEELTLEGIKQFYINVEREEWKLDTLCDLYETLTITQAVIFLNTRRKVDWLTEKMHARDFTVSALHGDMDQKERDVIMREFRSGSSRVLITTDLLARGIDVQQVSLVINYDLPTNRENYIHRIGRGGRFGRKGVAINFVTEEDKRILRDIETFYNTTVEEMPMNVADLI

SEQ ID NO: 120 - protein, 1179 aa, Homo sapiens
MAACGRVRRMFRLSAALHLLLLFAAGAEKLPGHGVHSQGQGPGANFVSFVGQAGGGGPAGQQLPQLLQSSQLQQQQQQQQQQQQLQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 121 - protein, 2817 aa, Homo sapiens
MSEKSGQSTKAKDGKKYATLSLFNTYKGKSLETQKTTARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARKRREEEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSAPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDSTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 122 - protein, 215 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 123 - protein, 209 aa, Homo sapiens
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEKDIAAYRAKGKSEAGKKGPGRPTGSKKKNEPEDEEEEEEEEDEDEEEEDEDEE

SEQ ID NO: 124 - protein, 911 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMPQLNFGMADPTQMGGLSMLLLAGEHALGTPEVSSGTCRPDVSESPELRQKSPLFQFAEISSSTSHSDASTKQCQTSALFQFAEISSNTSQLGGAEPVKRCGKSALFQLAEMCLASEGMKMEESKLIKAKESDGGRIKELEKGKEEKEIKMEKTDETRLQKEAEFEKSAKENLRDSKELRNFEALQIDDIMAIKMEDPKEIRKEELEEDHKCSHFPDFSYSASSKIIISDVPSRKDHMCHPHGIMIIEDPAALNKPEKLKKKKKKSKMDRHGNDKSTPKKTCKKRQSSESDIESVIYTIEAVAKGDWGIEKLGDTPRKKVRTSSSGKGSILDAKPPKKKVKSREKKMSKEKSSDTTKESRPPDFISISASKNISGETPEGIKAEPLTPMEDALPPSLSGQAKPEDSDCHRKIETCGSRKSERSCKGALYKTLVSEGMLTSLRANVDRGKRSSGKGNSSDHEGCWNEESWTFSQSGTSGSKKFKKTKPKEDCLLGSAKLDEEFEKKFNSLPQYSPVTFDRKCVPVPRKKKKTGNVSSEPTKTSKGSGDKWSNKQLFLDAIHPTEAIFSEDRNTMEPVHKVKNIPSIFNTPEPTTTQEPLVGSQKRKARKTKITHLVRTADGRVSPAGGTLDDKPKEQLQRSLPKATETDCNDKCSHNTEVGETRSSTPEMPAVSAFFSLAALAEVAAMENVHRGQRSTPLTHDGQPKEMPQAPVLISCADQ

SEQ ID NO: 125 - protein, 195 aa, Homo sapiens
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEKDIAAYRAKGKSEAGKKGPGRPTGSKKKNEPEDEEEEEE

SEQ ID NO: 126 - protein, 705 aa, Homo sapiens
DQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKVVVVCPKDEDYKQRTQKKAEVEGKDLPEHAVLKMKGNFTLPEVAECFDEITYVELQKEEAQKLLEQYKEESKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 127 - protein, 415 aa, Homo sapiens
MMLGPEGGEGFVVKLRGLPWSCSVEDVQNFLSDCTIHDGAAGVHFIYTREGRQSGEAFVELGSEDDVKMALKKDRESMGHRYIEVFKSHRTEMDWVLKHSGPNSADSANDGFVRLRGLPFGCTKEEIVQFFSGLEIVPNGITLPVDPEGKITGEAFVQFASQELAEKALGKHKERIGHRYIEVFKSSQEEVRSYSDPPLKFMSVQRPGPYDRPGTARRYIGIVKQAGLERMRPGAYSTGYGGYEEYSGLSDGYGFTTDLFGRDLSYCLSGMYDHRYGDSEFTVQSTTGHCVHMRGLPYKATENDIYNFFSPLNPVRVHIEIGPDGRVTGEADVEFATHEEAVAAMSKDRANMQHRYIELFLNSTTGASNGAYSSQVMQGMGVSAAQATYSGLESQSVSGCYGAGYSGQNSMGGYD

SEQ ID NO: 128 - protein, 243 aa, Homo sapiens
MDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 129 - protein, 321 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKTVIQKYHTVNGHNCEVRKALSKQEMASASSSQRGRSGSGNFGGGRGGGFGGNDNFGRGGNFSGRGGFGGSHGGGGYGGSGDGYNGFGNDGSNFGGGGSYNDFGNYNNQSSNFGPMKGGNFGGRSSGPYGGGGQYFAKPRNQVAMAVPAAAVAMAVAEDFN

SEQ ID NO: 130 - protein, 806 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEESKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 131 - protein, 896 aa, Homo sapiens [sequence omitted]

SEQ ID NO: 132 - protein, 1388 aa, Homo sapiens
MAPGCKTELRSVTNGQSNQPSNEGDAIKVFVRIRPPAERSGSADGEQNLCLSVLSSTSLRLHSNPEPKTFTFDHVADVDTTQESVFATVAKSIVESCMSGYNGTIFAYGQTGSGKTFTMMGPSESDNFSHNLRGVIPRSFEYLFSLIDREKEKAGAGKSFLCKCSFIEIYNEQIYDLLDSASAGLYLREHIKKGVFVVGAVEQVVTSAAEAYQVLSGGWRNRRVASTSMNRESSRSHAVFTITIESMEKSNEIVNIRTSLLNLVDLAGSERQKDTHAEGMRLKEAGNINRSLSCLGQVITALVDVGNGKQRHVCYRDSKLTFLLRDSLGGNAKTAIIANVHPGSRCFGETLSTLNFAQRAKLIKNKAVVNEDTQGNVSQLQAEVKRLKEQLAELASGQTPPESFLTRDKKKTNYMEYFQEAMLFFKKSEQEKKSLIEKVTQLEDLTLKKEKFIQSNKMIVKFREDQIIRLEKLHKESRGGFLPEEQDRLLSELRNEIQTLREQIEHHPRVAKYAMENHSLREENRRLRLLEPVKRAQEMDAQTIAKLEKAFSEISGMEKSDKNQQGFSPKAQKEPCLFANTEKLKAQLLQIQTELNNSKQEYEEFKELTRKRQLELESELQSLQKANLNLENLLEATKACKRQEVSQLNKIHAETLKIITTPTKAYQLHSRPVPKLSPEMGSFGSLYTQNSSILDNDILNEPVPPEMNEQAFEAISEELRTVQEQMSALQAKLDEEEHKNLKLQQHVDKLEHHSTQMQELFSSERIDWTKQQEELLSQLNVLEKQLQETQTKNDFLKSEVHDLRVVLHSADKELSSVKLEYSSFKTNQEKEFNKLSERHMHVQLQLDNLRLENEKLLESKACLQDSYDNLQEIMKFEIDQLSRNLQNFKKENETLKSDLNNLMELLEAEKERNNKLSLQFEEDKENSSKEILKVLEAVRQEKQKETAKCEQQMAKVQKLEESLLATEKVISSLEKSRDSDKKVVADLMNQIQELRTSVCEKTETIDTLKQELKDINCKYNSALVDREESRVLIKKQEVDILDLKETLRLRILSEDIERDMLCEDLAHATEQLNMLTEASKKHSGLLQSAQEELTKKEALIQELQHKLNQKKEEVEQKKNEYNFKMRQLEHVMDSAAEDPQSPKTPPHFQTHLAKLLETQEQEIEDGRASKTSLEHLVTKLNEDREVKNAEILRMKEQLREMENLRLESQQLIEKNWLLQGQLDDIKRQKENSDQNHPDNQQLKNEQEESIKERLAKSKIVEEMLKMKADLEEVQSALYNKEMECLRMTDEVERTQTLESKAFQEKEQLRSKLEEMYEERERTSQEMEMLRKQVECLAEENGKLVGHQNLHQKIQYVVRLKKENVRLAEETEKLRAENVFLKEKKRSES

SEQ ID NO: 133 - protein, 1300 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 134 - protein, 478 aa, Homo sapiens
MPPMPSAPPVHPPPDGGWGWIVVGAAFISIGFSYAFPKAVTVFFKEIQQIFHTTYSEIAWISSIMLAVMYAGGPVSSVLVNKYGSRPVVIAGGLLCCLGMVLASFSSSVVQLYLTMGFITGLGLAFNLQPALTIIGKYFYRKRPMANGLAMAGSPVFLSSLAPFNQYLFNTFGWKGSFLILGSLLLNACVAGSLMRPLGPNQTTSKSKNKTGKTEDDSSPKKIKTKKSTWEKVNKYLDFSLFKHRGFLIYLSGNVIMFLGFFAPIIFLAPYAKDQGIDEYSAAFLLSVMAFVDMFARPSVGLIANSKYIRPRIQYFFSFAIMFNGVCHLLCPLAQDYTSLVLYAVFFGLGFGSVSSVLFETLMDLVGAPRFSSAVGLVTIVECGPVLLGPPLAGKLVDLTGEYKYMYMSCGAIVVAASVWLLIGNAINYRLLAKERKEENARQKSRESEPLSKSKHSEDVNVKVSNAQSVTSERETNI

SEQ ID NO: 135 - protein, 1912 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 136 - protein, 362 aa, Homo sapiens
MAPKQDPKPKFQEGERVLCFHGPLLYEAKCVKVAIKDKQVKYFIHYSGWNKKSAVRPRRSEKSLKTHEDIVALFPVPEGAPSVHHPLLTSSWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGIKEYFNVMLGTQLLYKFERPQYAEILADHPDAPMSQVYGAPHLLRLFVRIGAMLAYTPLDEKSLALLLNYLHDFLKYLAKNSATLFSASDYEVAPPEYHRKAV

SEQ ID NO: 137 - protein, 323 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGIKEYFNVMLGTQLLYKFERPQYAEILADHPDAPMSQVYGAPHLLRLFVRIGAMLAYTPLDEKSLALLLNYLHDFLKYLAKNSATLFSASDYEVAPPEYHRKAV

SEQ ID NO: 138 - protein, 362 aa, Mus musculus
MAPKQDPKPKFQEGERVLCFHGPLLYEAKCVKVAIKDKQVKYFIHYSGWNKKSAVRPRRSEKSLKTREDIVALFPVPEGAPSVHHPLLTSSWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGIKEYFNVMLGTQLLYKFERPQYAEILADHPDAPMSQVYGAPHLLRLFVRIGAMLAYTPLDEKSLALLLNYLHDFLKYLAKNSATLFSASDYEVAPPEYHRKAV

SEQ ID NO: 139 - protein, 758 aa, Homo sapiens
MSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPIDIDQLSGRDFCHSKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 140 - protein, 2024 aa, Homo sapiens; identical to SEQ ID NO: 97

SEQ ID NO: 141 - protein, 2024 aa, Homo sapiens; identical to SEQ ID NO: 98

SEQ ID NO: 142 - protein, 801 aa, Homo sapiens
MHHRMNEMNLSPVGMEQLTSSSVSNALPVSGSHLGLAASPTHSAIPAPGLPVAIPNLGPSLSSLPSALSLMLPMGIGDRGVMCGLPERNYTLPPPPYPHLESSYFRTILPGILSYLADRPPPQYIHPNSINVDGNTALSITNNPSALDPYQSNGNVGLEPGIVSIDSRSVNTHGAQSLHPSDGHEVALDTAITMENVSRVTSPISTDGMAEELTMDGVAGEHSQIPNGSRSHEPLSVDSVSNNLAADAVGHGGVIPMHGNGLELPVVMETDHIASRVNGMSDSALSDSIHTVAMSTNSVSVALSTSHNLASLESVSLHEVGLSLEPVAVSSITQEVAMGTGHVDVSSDSLSFVSPSLQMEDSNSNKENMATLFTIWCTLCDRAYPSDCPEHGPVTFVPDTPIESRARLSLPKQLVLRQSIVGAEVGVWTGETIPVRTCFGPLIGQQSHSMEVAEWTDKAVNHIWKIYHNGVLEFCIITTDENECNWMMFVRKARNREEQNLVAYPHDGKIFFCTSQDIPPENELLFYYSRDYAQQIGVPEHPDVHLCNCGKECNSYTEFKAHLTSHIHNHLPTQGHSGSHGPSHSKERKWKCSMCPQAFISPSKLHVHFMGHMGMKPHKCDFCSKAFSDPSNLRTHLKIHTGQKNYRCTLCDKSFTQKAHLESHMVIHTGEKNLKCDYCDKLFMRRQDLKQHVLIHTQERQIKCPKCDKLFLRTNHLKKHLNSHEGKRDYVCEKCTKAYLTKYHLTRHLKTCKGPTSSSSAPEEEEEDDSEEEDLADSVGTEDCRINSAVYSADESLSAHK

SEQ ID NO: 143 - protein, 381 aa, Homo sapiens
MKTVKEKKECQRLRKSAKTRRVTQRKPSSGPVCWLCLREPGDPEKLGEFLQKDNISVHYFCLILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMLRMGIHIPDRDAAWELEPGAFSDLYQRYQHCDAPICLYEQGRDSFEDEGRWCLILCATCGSHGTHRDCSSLRSNSKKWECEECSPAAATDYIPENSGDIPCCSSTFHPEEHFCRDNTLEENPGLSWTDWPEPSLLEKPESSRGRRSYSWRSKGVRITNSCKKSK

SEQ ID NO: 144 - protein, 342 aa, Homo sapiens
MKTVKEKKECQRLRKSAKTRRVTQRKPSSGPVCWLCLREPGDPEKLGEFLQKDNISVHYFCLILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMLRMGIHIPDRRWCLILCATCGSHGTHRDCSSLRSNSKKWECEECSPAAATDYIPENSGDIPCCSSTFHPEEHFCRDNTLEENPGLSWTDWPEPSLLEKPESSRGRRSYSWRSKGVRITNSCKKSK

SEQ ID NO: 145 - protein, 717 aa, Homo sapiens
MAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRRIFGLLMGTLQKFKQESTVATERQKRRQEIEQKLEVQAEEERKQVENERRELFEERRAKQTELRLLEQKVELAQLQEEWNEHNAKIIKYIRTKTKPHLFYIPGRMCPATQKLIEESQRKMNALFEGRRIEFAEQINKMEARPRRQSMKEKEHQVVRNEEQKAEQEEGKVAQREEELEETGNQHNDVEIEEAGEEEEKEIAIVHSDAEKEQEEEEQKQEMEVKMEEETEVRESEKQQDSQPEEVMDVLEMVENVKHVIADQEVMETNRVESVEPSENEASKELEPEMEFEIEPDKECKSLSPGKENVSALDMEKESEEKEEKESEPQPEPVAQPQPQSQPQLQLQSQSQPVLQSQPPSQPEDLSLAVLQPTPQVTQEQGHLLPERKDFPVESVKLTEVPVEPVLTVHPESKSKTKTRSRSRGRARNKTSKSRSRSSSSSSSSSSSTSSSSGSSSSSGSSSSRSSSSSSSSTSGSSSRDSSSSTSSSSESRSRSRGRGHNRDRKHRRSVDRKRRDTSGLERSHKSSKGGSSRDTKGSKDKNSRSDRKRSISESSRSGKRSSRSERDRKSDRKDKRR

SEQ ID NO: 146 - protein, 717 aa, Homo sapiens; identical to SEQ ID NO: 145

SEQ ID NO: 147 - protein, 439 aa, Homo sapiens
MNLLPNIESPVTRQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 148 - protein, 406 aa, Homo sapiens
MALDGPEQMELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGARMVRELFVMAREHAPSIIFMDEIDSIGSSRLEGGSGGDSEVQRTMLELLNQLDGFEATKNIKVIMATNRIDILDSALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 149 - protein, 248 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 150 - protein, 145 aa, Homo sapiens
TTTGNKVFGALKGAVDGGLSIPHSTKRFPGYDSESKEFNAEVHRKHIMGQNVADYMRYLMEEDEDAYKKQFSQYIKNSVTPDMMEEMYKKAHAAIRENPVYEKKPKKEVKKKRWNRPKMSLAQKKDRVAQKKASFLRAQERAAES

SEQ ID NO: 151 - protein, 277 aa, Homo sapiens
MSHRKFSAPRHGSLGFLPRKRTSRHRGKVKSFPKDDPSKPVHLTAFLGYKAGMTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPVRVAFSVARAGQKGYHHR

SEQ ID NO: 152 - protein, 297 aa, Homo sapiens [sequence omitted]

SEQ ID NO: 153 - protein, 248 aa, Homo sapiens [sequence omitted]

SEQ ID NO: 154 - protein, 192 aa, Homo sapiens [sequence omitted]

SEQ ID NO: 155 - protein, 143 aa, Homo sapiens [sequence omitted]

SEQ ID NO: 156 - protein, 115 aa, Homo sapiens [sequence omitted]

SEQ ID NO: 157 - protein, 266 aa, Homo sapiens [sequence omitted]

SEQ ID NO: 158 - protein, 427 aa, Homo sapiens [sequence omitted]

SEQ ID NO: 159 - protein, 376 aa, Homo sapiens
MDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 160 - protein, 872 aa, Homo sapiens
MAPGAAQELQAKLAEIGAPIQGNREELVERLQSYTRQTGIVLNRPVLRGEDGDKAAPPPMSAQLPGIPMPPPPLGLPPLQPPPPPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 161 - protein, 125 aa, Homo sapiens
MAMQAAKRANIRLPPEVNRILYIRNLPYKITAEEMYDIFGKYGPIRQIRVGNTPETRGTAYVVYEDIFDAKNACDHLSGFNVCNRYLVVLYYNANRAFQKMDTKKKEEQLKLLKEKYGINTDPPK

SEQ ID NO: 162 - protein, 434 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPRPFRGRNTAMDAQEALARRLERAKKLQEQREKEMVEKQKQQEIAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDQNVKFRKLMGIKSEDEAGCSSVDEESYKTLKQQEEVFRNLDAQYEMARSQTHTQRGMGLGFTSSMRGMDAV

SEQ ID NO: 163 - protein, 239 aa, Homo sapiens
MAALKSWLSRSVTSFFRYRQCLCVPVVANFKKRCFSELIRPWHKTVTIGFGVTLCAVPIAQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 164 - protein, 171 aa, Homo sapiens
MAKFVIRPATAADCSDILRLIKELAKYEYMEEQVILTEKDLLEDGFGEHPFYHCLVAEVPKEHWTPEGHSIVGFAMYYFTYDPWIGKLLYLEDFFVMSDYRGFGIGSEILKNLSQVAMRCRCSSMHFLVAEWNEPSINFYKRRGASDLSSEEGWRLFKIDKEYLLKMATEE

SEQ ID NO: 165 - protein, 359 aa, Homo sapiens
MPNPSSTSSPYPLPEEIRNLLADVETFVADILKGENLSKKAKEKRESLIKKIKDVKSIYLQEFQDKGDAEDGEEYDDPFAGPPDTISLASERYDKDDEAPSDGAQFPPIAAQDLPFVLKAGYLEKRRKDHSFLGFEWQKRWCALSKTVFYYYGSDKDKQQKGEFAIDGYSVRMNNTLRKDGKKDCCFEISAPDKRIYQFTAASPKDAEEWVQQLKFVLQDMESDIIPEDYDERGELYDDVDHPLPISNPLTSSQPIDDEIYEELPEEEEDSAPVKVEEQRKMSQDSVHHTSGDKSTDYANFYQGLWDCTGAFSDELSFKRGDVIYILSKEYNRYGWWVGEMKGAIGLVPKAYIMEMYDI

SEQ ID NO: 166 - protein, 301 aa, Homo sapiens
MLEPQENGVIDLPDYEHVEDETFPPFPPPASPERQDGEGTEPDEESGNGAPVPVPPKRTVKRNIPKLDAQRLISERGLPALRHVFDKAKFKGKGHEAEDLKMLIRHMEHWAHRLFPKLQFEDFIDRVEYLGSKKEVQTCLKRIRLDLPILHEDFVSNNDEVAENNEHDVTSTELDPFLTNLSESEMFASELSRSLTEEQQQRIERNKQLALERRQAKLLSNSQTLGNDMLMNTPRAHTVEEVNTDEDQKEESNGLNEDILDNPCNDAIANTLNEEETLLDQSFKNVQQQLDATSRNITEAR

SEQ ID NO: 167 - protein, 301 aa, Homo sapiens; identical to SEQ ID NO: 166

SEQ ID NO: 168 - protein, 866 aa, Homo sapiens
MPAVSLPPKENALFKRILRCYEHKQYRNGLKFCKQILSNPKFAEHGETLAMKGLTLNCLGKKEEAYELVRRGLRNDLKSHVCWHVYGLLQRSDKKYDEAIKCYRNALKWDKDNLQILRDLSLLQIQMRDLEGYRETRYQLLQLRPAQRASWIGYAIAYHLLEDYEMAAKILEEFRKTQQTSPDKVDYEYSELLLYQNQVLREAGLYREALEHLCTYEKQICDKLAVEETKGELLLQLCRLEDAADVYRGLQERNPENWAYYKGLEKALKPANMLERLKIYEEAWTKYPRGLVPRRLPLNFLSGEKFKECLDKFLRMNFSKGCPPVFNTLRSLYKDKEKVAIIEELVVGYETSLKSCRLFNPNDDGKEEPPTTLLWVQYYLAQHYDKIGQPSIALEYINTAIESTPTLIELFLVKAKIYKHAGNIKEAARWMDEAQALDTADRFINSKCAKYMLKANLIKEAEEMCSKFTREGTSAVENLNEMQCMWFQTECAQAYKAMNKFGEALKKCHEIERHFIEITDDQFDFHTYCMRKITLRSYVDLLKLEDVLRQHPFYFKAARIAIEIYLKLHDNPLTDENKEHEADTANMSDKELKKLRNKQRRAQKKAQIEEEKKNAEKEKQQRNQKKKKDDDDEEIGGPKEELIPEKLAKVETPLEEAIKFLTPLKNLVKNKIETHLFAFEIYFRKEKFLLMLQSVKRAFAIDSSHPWLHECMIRLFNTAVCESKDLSDTVRTVLKQEMNRLFGATNPKNFNETFLKRNSDSLPHRLSAAKMVYYLDPSSQKRAIELATTLDESLTNRNLQTCMEVLEALYDGSLGDCKEAAEIYRANCHKLFPYALAFMPPGYEEDMKITVNGDSSAEAEELANEI

SEQ ID NO: 169 - protein, 1507 aa, Homo sapiens
MTTVVVHVDSKAELTTLLEQWEKEHGSGQDMVPILTRMSQLIEKETEEYRKGDPDPFDDRHPGRADPECMLGHLLRILFKNDDFMNALVNAYVMTSREPPLNTAACRLLLDIMPGLETAVVFQEKEGIVENLFKWAREADQPLRTYSTGLLGGAMENQDIAANYRDENSQLVAIVLRRLRELQLQEVALRQENKRPSPRKLSSEPLLPLDEEAVDMDYGDMAVDVVDGDQEEASGDMEISFHLDSGHKTSSRVNSTTKPEDGGLKKNKSAKQGDRENFRKAKQKLGFSSSDPDRMFVELSNSSWSEMSPWVIGTNYTLYPMTPAIEQRLILQYLTPLGEYQELLPIFMQLGSRELMMFYIDLKQTNDVLLTFEALKHLASLLLHNKFATEFVAHGGVQKLLEIPRPSMAATGVSMCLYYLSYNQDAMERVCMHPHNVLSDVVNYTLWLMECSHASGCCHATMFFSICFSFRAVLELFDRYDGLRRLVNLISTLEILNLEDQGALLSDDEIFASRQTGKHTCMALRKYFEAHLAIKLEQVKQSLQRTEGGILVHPQPPYKACSYTHEQIVEMMEFLIEYGPAQLYWEPAEVFLKLSCVQLLLQLISIACNWKTYYARNDTVRFALDVLAILTVVPKIQLQLAESVDVLDEAGSTVSTVGISIILGVAEGEFFIHDAEIQKSALQIIINCVCGPDNRISSIGKFISGTPRRKLPQNPKSSEHTLAKMWNVVQSNNGIKVLLSLLSIKMPITDADQIRALACKALVGLSRSSTVRQIISKLPLFSSCQIQQLMKEPVLQDKRSDHVKFCKYAAELIERVSGKPLLIGTDVSLARLQKADVVAQSRISFPEKELLLLIRNHLISKGLGETATVLTKEADLPMTAASHSSAFTPVTAAASPVSLPRTPRIANGIATRLGSHAAVGASAPSAPTAHPQPRPPQGPLALPGPSYAGNSPLIGRISFIRERPSPCNGRKIRVLRQKSDHGAYSQSPAIKKQLDRHLPSPPTLDSIITEYLREQHARCKNPVATCPPFSLFTPHQCPEPKQRRQAPINFTSRLNRRASFPKYGGVDGGCFDRHLIFSRFRPISVFREANEDESGFTCCAFSARERFLMLGTCTGQLKLYNVFSGQEEASYNCHNSAITHLEPSRDGSLLLTSATWSQPLSALWGMKSVFDMKHSFTEDHYVEFSKHSQDRVIGTKGDIAHIYDIQTGNKLLTLFNPDLANNYKRNCATFNPTDDLVLNDGVLWDVRSAQAIHKFDKFNMNISGVFHPNGLEVIINTEIWDLRTFHLLHTVPALDQCRVVFNHTGTVMYGAMLQADDEDDLMEERMKSPFGSSFRTFNATDYKPIATIDVKRNIFDLCTDTKDCYLAVIENQGSMDALNMDTVCRLYEVGRQRLAEDEDEEEDQEEEEQEEEDDDEDDDDTDDLDELDTDQLLEAELEEDDNNENAGEDGDNDFSPSDEELANLLEEGEDGEDEDSDADEEVELILGDTDSSDNSDLEDDIILSLNE

SEQ ID NO: 170 - protein, 1058 aa, Homo sapiens
MTTVVVHVDSKAELTTLLEQWEKEHGSGQDMVPILTRMSQLIEKETEEYRKGDPDPFDDRHPGRADPECMLGHLLRILFKNDDFMNALVNAYVMTSREPPLNTAACRLLLDIMPGLETAVVFQEKEGIVENLFKWAREADQPLRTYSTGLLGGAMENQDIAANYRDENSQLVAIVLRRLRELQLQEVALRQENKRPSPRKLSSEPLLPLDEEAVDMDYGDMAVDDAEIQKSALQIIINCVCGPDNRISSIGKFISGTPRRKLPQNPKSSEHTLAKMWNVVQSNNGIKVLLSLLSIKMPITDADQIRALACKALVGLSRSSTVRQIISKLPLFSSCQIQQLMKEPVLQDKRSDHVKFCKYAAELIERVSGKPLLIGTDVSLARLQKADVVAQSRISFPEKELLLLIRNHLISKGLGETATVLTKEADLPMTAASHSSAFTPVTAAASPVSLPRTPRIANGIATRLGSHAAVGASAPSAPTAHPQPRPPQGPLALPGPSYAGNSPLIGRISFIRERPSPCNGRKIRVLRQKSDHGAYSQSPAIKKQLDRHLPSPPTLDSIITEYLREQHARCKNPVATCPPFSLFTPHQCPEPKQRRQAPINFTSRLNRRASFPKYGGVDGGCFDRHLIFSRFRPISVFREANEDESGFTCCAFSARERFLMLGTCTGQLKLYNVFSGQEEASYNCHNSAITHLEPSRDGSLLLTSATWSQPLSALWGMKSVFDMKHSFTEDHYVEFSKHSQDRVIGTKGDIAHIYDIQTGNKLLTLFNPDLANNYKRNCATFNPTDDLVLNDGVLWDVRSAQAIHKFDKFNMNISGVFHPNGLEVIINTEIWDLRTFHLLHTVPALDQCRVVFNHTGTVMYGAMLQADDEDDLMEERMKSPFGSSFRTFNATDYKPIATIDVKRNIFDLCTDTKDCYLAVIENQGSMDALNMDTVCRLYEVGRQRLAEDEDEEEDQEEEEQEEEDDDEDDDDTDDLDELDTDQLLEAELEEDDNNENAGEDGDNDFSPSDEELANLLEEGEDGEDEDSDADEEVELILGDTDSSDNSDLEDDIILSLNE

SEQ ID NO: 171 - protein, 1275 aa, Homo sapiens [sequence omitted]

SEQ ID NO: 172 - protein, 1275 aa, Homo sapiens [sequence omitted]

SEQ ID NO: 173 - protein, 215 aa, Homo sapiens
MEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRKTNKGLAHYLKEYKEAIHDMNFSNEDMIREFDNMAKVQDEKRKSKQKLGAFLWMQRNLQDPFYPRGPREFRGGCRAPRRDIEDIPYV

SEQ ID NO: 174 - protein, 2492 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKGLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 175 - protein, 916 aa, Homo sapiens
MSYTLDSLGNPSAYRRVTETRSSFSRVSGSPSSGFRSQSWSRGSPSTVSSSYKRSMLAPRLAYSSAMLSSAESSLDFSQSSSLLNGGSGPGGDYKLSRSNEKEQLQGLNDRFAGYIEKVHYLEQQNKEIEAEIQALRQKQASHAQLGDAYDQEIRELRATLEMVNHEKAQVQLDSDHLEEDIHRLKERFEEEARLRDDTEAAIRALRKDIEEASLVKVELDKKVQSLQDEVAFLRSNHEEEVADLLAQIQASHITVERKDYLKTDISTALKEIRSQLESHSDQNMHQAEEWFKCRYAKLTEAAEQNKEAIRSAKEEIAEYRRQLQSKSIELESVRGTKESLERQLSDIEERHNHDLSSYQDTIQQLENELRGTKWEMARHLREYQDLLNVKMALDIEIAAYRKLLEGEETRFSTFAGSITGPLYTHRPPITISSKIQKPKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVPKSPVEEKGKSPVPKSPVEEKGKSPVPKSPVEEKGKSPVSKSPVEEKAKSPVPKSPVEEAKSKAEVGKGEQKEEEEKEVKEAPKEEKVEKKEEKPKDVPEKKKAESPVKEEAVAEVVTITKSVKVHLEKETKEEGKPLQQEKEKEKAGGEGGSEEEGSDKGAKGSRKEDIAVNGEVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 176 - protein, 2320 aa, Homo sapiens [sequence omitted]

SEQ ID NO: 177 - protein, 122 aa, Homo sapiens
MAPRGRKRKAEAAVVAVAEKREKLANGGEGMEEATVVIEHCTSCRVYGRNAAALSQALRLEAPELPVKVNPTKPRRGSFEVTLLRPDGSSAELWTGIKKGPPRKLKFPEPQEVVEELKKYLS

SEQ ID NO: 178 - protein, 498 aa, Homo sapiens
MLEEGVLPSPGPALPQEENTGEEGMAAGLLIAGPRGSTFFSSVTVAFAQEGWRCLVSTPRDRFKEGIPGKSRSLVLLGLPVSQPGMNSQLEQREGAWMLEGEDLRSPSPGWKIISGSPPEQALSEASFQDPCVEMPPGDSDHGTSDLEKSFNLRPVLSPQQRVPVEARPRKCETHTESFKNSEILKPHRAKPYACNECGKAFSYCSSLSQHQKSHTGEKPYECSECGKAFSQSSSLIQHQRIHTGEKPYKCSECGRAFSQNANLTKHQRTHTGEKPYRCSECEKAFSDCSALVQHQRIHTGEKPYECSDCGKAFRHSANLTNHQRTHTGEKPYKCSECGKAFSYCAAFIQHQRIHTGEKPYRCAACGKAFSQSANLTNHQRTHTGEKPYKCSECGKAFSQSTNLIIHQKTHTGEKPYKCNECGKFFSESSALIRHHIIHTGEKPYECNECGKAFNQSSSLSQHQRIHTGVKPYECSECGKAFRCSSAFVRHQRLHAGE

SEQ ID NO: 179 - protein, 409 aa, Homo sapiens
MLVGQSDDESINFDAWLRNYSQNNSKNYSLKYTKYTKKDTKKNAKKSSDAESEDSKDAKKDSKKVKKNVKKDDKKKDVKKDTESTDAESGDSKDERKDTKKDKKKLKKDDKKKDTKKYPESTDTESGDAKDARNDSRNLKKASKNDDKKKDAKKITFSTDSESELESKESQKDEKKDKKDSKTDNKKSVKNDEESTDADSEPKGDSKKGKKDEKKGKKDSKKDDKKKDAKKNAESTEMESDLELKKDKKHSKEKKGSKKDIKKDARKDTESTDAEFDESSKTGFKTSTKIKGSDTESEESLYKPGAKKKIDESDGTSANSKMEGLESKRGFRMSSKKTTFNEKGEKASTGRVPPSREKPPLPACEPSLPSPKVRRLCWCKMPPPPPKPRYAPLIQRRQRLGVRRCQLLM

SEQ ID NO: 180 - protein, 146 aa, Homo sapiens [sequence omitted]

SEQ ID NO: 181 - protein, 384 aa, Homo sapiens
MARALVQFWAICMLRVALATVYFQEEFLDGEHWRNRWLQSTNDSRFGHFRLSSGKFYGHKEKDKGLQTTQNGRFYAISARFKPFSNKGKTLVIQYTVKHEQKMDCGGGYIKVFPADIDQKNLNGKSQYYIMFGPDICGFDIKKVHVILHFKNKYHENKKLIRCKVDGFTHLYTLILRPDLSYDVKIDGQSIESGSIEYDWNLTSLKKETSPAESKDWEQTKDNKAQDWEKHFLDASTSKQSDWNGDLDGDWPAPMLQKPPYQDGLKPEGIHKDVWLHRKMKNTDYLTQYDLSEFENIGAIGLELWQVRSGTIFDNFLITDDEEYADNFGKATWGETKGPEREMDAIQAKEEMKKAREEEEEELLSGKINRHEHYFNQFHRRNEL

SEQ ID NO: 182 - protein, 839 aa, Homo sapiens
MSVVGIDLGFLNCYIAVARSGGIETIANEYSDRCTPACISLGSRTRAIGNAAKSQIVTNVRNTIHGFKKLHGRSFDDPIVQTERIRLPYELQKMPNGSAGVKVRYLEEERPFAIEQVTGMLLAKLKETSENALKKPVADCVISIPSFFTDAERRSVMAAAQVAGLNCLRLMNETTAVALAYGIYKQDLPPLDEKPRNVVFIDMGHSAYQVSVCAFNKGKLKVLATTFDPYLGGRNFDEALVDYFCDEFKTKYKINVKENSRALLRLYQECEKLKKLMSANASDLPLNIECFMNDLDVSSKMNRAQFEQLCASLLARVEPPLKAVMEQANLQREDISSIEIVGGATRIPAVKEQITKFFLKDISTTLNADEAVARGCALQCAILSPAFKVREFSITDLVPYSITLRWKTSFEDGSGECEVFCKNHPAPFSKVITFHKKEPFELEAFYTNLHEVPYPDARIGSFTIQNVFPQSDGDSSKVKVKVRVNIHGIFSVASASVIEKQNLEGDHSDAPMETETSFKNENKDNMDKMQVDQEEGHQKCHAEHTPEEEIDHTGAKTKSAVSDKQDRLNQTLKKGKVKSIDLPIQSSLCRQLGQDLLNSYIENEGKMIMQDKLEKERNDAKNAVEEYVYDFRDRLGTVYEKFITPEDLSKLSAVLEDTENWLYEDGEDQPKQVYVDKLQELKKYGQPIQMKYMEHEERPKALNDLGKKIQLVMKVIEAYRNKDERYDHLDPTEMEKVEKCISDAMSWLNSKMNAQNKLSLTQDPVVKVSEIVAKSKELDNFCNPIIYKPKPKAEVPEDKPKANSERNGPMDGQSGTETKSDSTKDSSQHTKSSGEMEVD

SEQ ID NO: 183 - protein, 840 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPAEEGSSDCEVFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERNDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 184 - protein, 127 aa, Homo sapiens
MRPLDIVELAEPEEVEVLEPEEDFEQFLLPVINEMREDIASLTREHGRAYLRNRSKLWEMDNMLIQIKTQVEASEESALNHLQNPGDAAEGRAAKRCEKAEEKAKEIAKMAEMLVELVRRIEKSESS

SEQ ID NO: 185 - protein, 802 aa, Homo sapiens
MAAEALAAEAVASRLERQEEDIRWLWSEVERLRDEQLNAPYSCQAEGPCLTREVAQLRAENCDLRHRLCSLRLCLAEERSRQATLESAELEAAQEAGAQPPPSQSQDKDMKKKKMKESEADSEVKHQPIFIKERLKLFEILKKDHQLLLAIYGKKGDTSNIITVRVADGQTVQGEVWKTTPYQVAAEISQELAESTVIAKVNGELWDLDRPLEGDSSLELLTFDNEEAQAVYWHSSAHILGEAMELYYGGHLCYGPPIENGFYYDMFIEDRAVSSTELSALENICKAIIKEKQPFERLEVSKEILLEMFKYNKFKCRILNEKVNTATTTVYRCGPLIDLCKGPHVRHTGKIKTIKIFKNSSTYWEGNPEMETLQRIYGISFPDNKMMRDWEKFQEEAKNRDHRKIGKEQELFFFHDLSPGSCFFLPRGAFIYNTLTDFIREEYHKRDFTEVLSPNMYNSKLWEASGHWQHYSENMFTFEIEKDTFALKPMNCPGHCLMFAHRPRSWREMPIRFADFGVLHRNELSGTLSGLTRVRRFQQDDAHIFCTVEQIEEEIKGCLQFLQSVYSTFGFSFQLNLSTRPENFLGEIEMWNEAEKQLQNSLMDFGEPWKMNPGDGAFYGPKIDIKIKDAIGRYHQCATIQLDFQLPIRFNLTYVSKDGDDKKRPVIIHRAILGSVERMIAILSENYGGKWPFWLSPRQVMVIPVGPTCEKYALQVSSEFFEEGFMADVDLDHSCTLNKKIRNAQLAQYNFILVVGEKEKIDNAVNVRTRDNKIHGEILVTSAIDKLKNLRKTRTLNAEEAF

SEQ ID NO: 186 - protein, 361 aa, Homo sapiens [sequence omitted]

SEQ ID NO: 187 - protein, 477 aa, Homo sapiens
MGSGLDFAETSCAQPVVSTQSDKEPGITASAADTDNANGEEVPHTQEISVSWEGEAAPEIRTSKLGQPDPAPSKKKSNRLTLSKRKKEAQDEKVEKTQGGHEHRQEDRLKKTVQDHSQIRDQQKGEISGFGQCLVWVQCSFPNCGKWRRLCGNIDPSVLPDNWSCDQNTDVQYNRCDIPEETWTGLESDVAYASYIPGSIIWAKQYGYPWWPGMIESDPDLGEYFLFTSHLDSLPSKYHVTFFGETVSRAWIPVNMLKNFQELSLELSVMKKRRNDCSQKLGVALMMAQEAEQISIQERVNLFGFWSRFNGSNSNGERKDLQLSGLNSPGSCLEKKEKEEELEKEEGEKTDPILPIRKRVKIQTQKTKPRGPKKKFKAPQSKALAASFSEGKEVRTVPKNLGLSACKGACPSSAKEEPRHREPLTQEAGSVPLEDEASSDLDLEQLMEDVGRELGQSGELQHSNSDGEDFPVALFGK

SEQ ID NO: 188 - protein, 622 aa, Homo sapiens
MPPTQAESVIRSIIREIGQECAAHGEIVSETLIAFMVKAVVLDPSNGFNMDRTLMKSDVQNLVKLCMTRLLDTKNPSLDTIKMQVYFDMNYTNRVEFLEEHHRVLESRLGSVTREITDNRACAKEELESLYRKIISYVLLRSGLGSPTDIKTVREVTAALQSVFPQAELGTFLTLSKKDKERQLKELTMIVTGIRLFNRDCGKGGEGIDDLPAVLHVAIPATMQHIDYQLETARSQVYRYTAILEKAANDPLMRAELQPYMLKEALYNIRQYEVFLQIILSDIITGAQEVEMMTKQLGAHLEQLKMTIKSKIAVPTSQVFPIFIALSTLWTSLQDETIVVGVLSNLFTHIQPFLGAHELYFPERVMQCHLNGATVKTDVCRMKEHMEDRVNVADFRKLEWLFPETTANFDKLLIQYRGFCAYTFAATDGLLLPGNPAIGILKYKEKYYTFNSKDAAYSFAENPEHYIDIVREKAKKNTELIQLLELHQQFETFIPYSQMRDADKHYIKPITKCESSTQTNTHILPPTIVRSYEWNEWELRRKAIKLANLRQKVTHSVQTDLSHLRRENCSQVYPPKDTSTQSMREDSTGVPRPQIYLAGLRGGKSEITDEVKVNLTRDVDET

SEQ ID NO: 189 - protein, 678 aa, Homo sapiens
MEVLIGDPITTCLSPSVYDIICNLGFQLRENCDINSIVTQNGEVCWKTITDCVSYTESEQGLDYWGSVRLLGPVCEAVHSHFLSLTKGQFEIRYAPWFQWTSFPELFPEIFDALESLQSPAISLSLMKLTSCLERALGDVFLLIGKECPFLLRDLLSSEELAQVFSQSVMNVLKVFVGSPCGLNLRNVLWHGFASPEEIPPKYCSMMILLTAGLGQLLKSYLQNTKLTLAHRSFISLTNLEDLIVFPDVTYEVLSVLEEVMMKSAFILKIMLPYWEVALVKFKSHRFADCAILLLTQLETGLRNVFATLNRCPKRLLTAESTALYTTFDQILAKHLNDGKINQLPLFLGEPAMEFLWDFLNHQEGPRIRDHLSHGEINLHEFSKETTNQLLAFSLVLLLRFVDDCLLSVFKEKSAVELLISLAEGYSSRCHPVFQLKKQVLSCEESIRVWALLPFPEELTRQAVRLEDNSETNACHSLITKMTDELYHHMPENRCVLKDLDRLPTETWPQLLRELCSTPVPTLFCPRIVLEVLVVLRSISEQCRRVSSQVTVASELRHRQWVERTLRSRQRQNYLRMWSSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 190 - protein, 374 aa, Homo sapiens
MRAPMLQKQQAPRMDTPPPEERLEKQNEKLNNQEEETEFKELDGLREALANLRGLSEEERSEKAMLRSRIEEQSQLICILKRRSDEALERCQILELLNAELEEKMMQEAEKLKAQGEYSRKLEERFMTLAANHELMLRFKDEYKSENIKLREENEKLRLENSSLFSQALKDEEAKVLQLTVRCEALTGELETLKERCAQDACQAQAREKELLELQSQQACTHTKETEQLRSQLQTLKQQHQQAVEQIAKAEETHSSLSQELQARLQTVTREKEELLQLSIERGKVLQNKQAEICQLEEKLEIANEDRKHALERFEQEAVAVDSNLRVRELQRKVDGIQKAYDELRLQSEAFKKHSLDLLSKERELNGKLRHLSP

SEQ ID NO: 191 - protein, 199 aa, Homo sapiens
MLYTTSLMRTVYKPSLMRTLYMTLLTRTLYKALLTRTLYTTSLMRTPYKTSPMRMLYMTSLMTPTRHANEDAVDDIAYKDTVQDITNEDAVYDIANEDVVYDIANEDALQDIANEVAVYDIANEDIVYDIANEDALYDITNEDAVYNIANEDAVYGIANEDAVYEFANKDAVYDIANEDTVQDICKKEDAANVRHFSLS

SEQ ID NO: 192 - protein, 406 aa, Homo sapiens [sequence omitted]

SEQ ID NO: 193 - protein, 247 aa, Homo sapiens [sequence omitted]

SEQ ID NO: 194 - protein, 177 aa, Homo sapiens
MESIYLQKHLGACLTQGLAEVARVRPVDPIEYLALWIYKYKENVTMEQLRQKEMAKLERERELALMEQEMMERLKAEELLLQQQQLALQLELEMQEKERQRIQELQRAQEQLGKEMRMNMENLVRNEDILHSEEATLDSGKTLAEISDRYGAPNLSRVEELDEPMFSDIALNIDQDL

SEQ ID NO: 195 - protein, 810 aa, Homo sapiens
MSKKGRNKGEKPEALIVALQAANEDLRTKLTDIQIELHQEKSKVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLMDEIKAKDRIIFSLEKELETQTGYVQKLQLQKEALDEQLFLVKEAECNMSSPKREIPGRAGDGSEHCSSPDLRRNQKRIAELNATIRKLEDRNTLLGDERNELLKRVRETEKQCKPLLERNKCLAKRNDELMVSLQRMEEKLKAVTKENSEMREKITSHPPLKKLKSLNDLDQANEEQETEFLKLQVIEQQNIIDELTRDREKLIRRRKHRRSSKPIKRPVLDPFIGYDEDSMDSETSSMASFRTDRTPATPDDDLDESLAAEESELRFRQLTKEYQALQRAYALLQEQTGGIIDAEREAKAQEQLQAEVLRYKAKIEDLEATLAQKGQDSHWVEDKQLFIKRNQELLEKIEKQEAENHRLQQELQDARDQNELLEFRNLELEERERRSPPFNLQIHPFSDGVSALQIYCMKEGVKDVNIPDLIKQLDILGDNGNLRNEEQVAIIQASTVLSLAEKWIQQIEGAEAALHQKMMELESDMEQFCKIKGYLEEELDYRKQALDQAYMRIQELEATLYNALQQETVIKFGELLSEKQQEELRTAVEKLRRQMLRKSREYDCQILQERMELLQQAHQRIRDLEDKTDIQKRQIKDLEEKSNRKHG

SEQ ID NO: 196 - protein, 267 aa, Homo sapiens
MKGISGGVTVAALAARAEREELPVPAMEPQPTAWGSPHPEAVLQLEVAPESSGPCTDTAKDQQSDKLPDLMPPAVATGLSPGAESIAGDRRGREEVASMAPASSSHAAPSPGHGASLGVRDQGVQSELLYLTKERPLLFTRATALLPQDLFILPVLGLSICKLEVLRAGKGGCEEGFGQLLLLSEVASSSRHGGLSTTGLLGYLPLICSLVRALLNRQARGAGTRRGLQRVQYQIFQTQHLCPGVSKLSSALGFIHTVKLPVYANDM

SEQ ID NO: 197 - protein, 322 aa, Homo sapiens
AEPPRPVGERSMGSSREAARAPARSPAWASTQASTPGAALAVQRESPESGLQKHYSNLCMEKSQKINPFILHILQEVDEEIKKGLAAGITLNIAGNNRLVPVERVTGEDFWILSKILKNCLYINGLDVGYNLLCDVGAYYAAKLLQKQLNLIYLNLMFNDIGPEGGELIAKVLHKNRTLKYLRMTGNKIENKGGMFFAAMLQINSSLEKLDLGDCDLGMQSVIAFATVLTQNQAIKAINLNRPILYNEQEESTVHVGRMLKENHCLVALHMCKHDIKNSGIQQLCDALYLNSSLRYLDVSCNKITHDGMVYLADVLKSNTTL

SEQ ID NO: 198 - protein, 240 aa, Homo sapiens [sequence omitted]

SEQ ID NO: 199 - protein, 1059 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFRLDNLVFHPEEPEVLAVLDWELSTLGDPLADVAYSCLAHYLPSSFPVLRGINDCDLTQLGIPAAEEYFRMYCLQMGLPPTENWNFYMAFSFFRVAAILQGVYKRSLTGQASSTYAEQTGKLTEFVSNLAWDFAVKEGFRVFKEMPFTNPLTRSYHTWARPQSQWCPTGSRSYSSVPEASPAHTSRGGLVISPESLSPPVRELYHRLKHFMEQRVYPAEPELQSHQASAARWSPSPLIEDLKEKAKAEGLWNLFLPLEADPEKKYGAGLTNVEYAHLCELMGTSLYAPEVCNCSAPDTGNMELLVRYGTEAQKARWLIPLLEGKARSCFAMTEPQVASSDATNIEASIREEDSFYVINGHKWWITGILDPRCQLCVFMGKTDPHAPRHRQQSVLLVPMDTPGIKIIRPLTVYGLEDAPGGHGEVRFEHVRVPKENMVLGPGRGFEIAQGRLGPGRIHHCMRLIGFSERALALMKARVKSRLAFGKPLVEQGTVLADIAQSRVEIEQARLLVLRAAHLMDLAGNKAAALDIAMIKMVAPSMASRVIDRAIQAFGAAGLSSDYPLAQFFTWARALRFADGPDEVHRATVAKLELKHRI

SEQ ID NO: 200 - protein, 672 aa, Homo sapiens
MSDPEGETLRSTFPSYMAEGERLYLCGEFSKAAQSFSNALYLQDGDKNCLVARSKCFLKMGDLERSLKDAEASLQSDPAFCKGILQKAETLYTMGDFEFALVFYHRGYKLRPDREFRVGIQKAQEAINNSVGSPSSIKLENKGDLSFLSKQAENIKAQQKPQPMKHLLHPTKGEPKWKASLKSEKTVRQLLGELYVDKEYLEKLLLDEDLIKGTMKGGLTVEDLIMTGINYLDTHSNFWRQQKPIYARERDRKLMQEKWLRDHKRRPSQTAHYILKSLEDIDMLLTSGSAEGSLQKAEKVLKKVLEWNKEEVPNKDELVGNLYSCIGNAQIELGQMEAALQSHRKDLEIAKEYDLPDAKSRALDNIGRVFARVGKFQQAIDTWEEKIPLAKTTLEKTWLFHEIGRCYLELDQAWQAQNYGEKSQQCAEEEGDIEWQLNASVLVAQAQVKLRDFESAVNNFEKALERAKLVHNNEAQQAIISALDDANKGIIRELRKTNYVENLKEKSEGEASLYEDRIITREKDMRRVRDEPEKVVKQWDHSEDEKETDEDDEAFGEALQSPASGKQSVEAGKARSDLGAVAKGLSGELGTRSGETGRKLLEAGRRESREIYRRPSGELEQRLSGEFSRQEPEELKKLSEVGRREPEELGKTQFGEIGETKKTGNEMEKEYE

SEQ ID NO: 201 - protein, 453 aa, Homo sapiens
MDWKEVLRRRLATPNTCPNKKKSEQELKDEEMDLFTKYYSEWKGGRKNTNEFYKTIPRFYYRLPAEDEVLLQKLREESRAVFLQRKSRELLDNEELQNLWFLLDKHQTPPMIGEEAMINYENFLKVGEKAGAKCKQFFTAKVFAKLLHTDSYGRISIMQFFNYVMRKVWLHQTRIGLSLYDVAGQGYLRESDLENYILELIPTLPQLDGLEKSFYSFYVCTAVRKFFFFLDPLRTGKIKIQDILACSFLDDLLELRDEELSKESQETNWFSAPSALRVYGQYLNLDKDHNGMLSKEELSRYGTATMTNVFLDRVFQECLTYDGEMDYKTYLDFVLALENRKEPAALQYIFKLLDIENKGYLNVFSLNYFFRAIQELMKIHGQDPVSFQDVKDEIFDMVKPKDPLKISLQDLINSNQGDTVTTILIDLNGFWTYENREALVANDSENSADLDDT

SEQ ID NO: 202 - protein, 229 aa, Homo sapiens
MGNILTCCINSHCGWPRGKDAPCYESDTDIYETVAAATSESTTVEPGKLDVGATEGQDLQHISNQKMPTGPPEDRLSLKFLPSSEEDNDDAKILPSPVQGSSEDNLSLVCLPRSEDDDCDDDDDDDAQILPSRVQGGCYRFDSSSCSSEDNLSLVCLPRSEDDDCDDDDDDAQILPSPVQACSEDSLFLRCSLRHKDEEEEDDDDIHITARIESDLTLESLSDEEIHPG

SEQ ID NO: 203 - protein, 282 aa, Homo sapiens
MEMVQKLQKVGSLEPRVEVLINRINEVQQAKKKANKDLGEARTICEALQKELDSLHGEKVHLKEILSKKQETLRILRLHCQEKESEAHRKHTMLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVAPRPGRPVTWWS

SEQ ID NO: 204 - protein, 127 aa, Homo sapiens [sequence omitted]

SEQ ID NO: 205 - protein, 322 aa, Homo sapiens; identical to SEQ ID NO: 197

SEQ ID NO: 206 - protein, 138 aa, Homo sapiens
MDKLFRAYENWEGPYGLEGGNTVFFHNHRKNYLLSYSVGVFGTFIINSREGIRLRISAKLSIDRAMDRLLLLGAGESGKGTNVKQMRILHVNGFNGEDTEEDLQAARSNRDGIYYPWMMATVSHLPGYVLSQFACWNC

SEQ ID NO: 207 - protein, 429 aa, Homo sapiens
MATEQRPFHLVVFGASGFTGQFVTEEVAREQVDPERSSRLPWAVAGRSREKLQRVLEKAALKLGRPTLSSEVGIIICDIANPASLDEMAKQATVVLNCVGPYRFYGEPVIKACIENGASCIDISGEPQFLELMQLKYHEKAADKGVYIIGSSGFDSIPADLGVIYTRNKMNGTLTAVESFLTIHSGPEGLSIHDGTWKSAIYGFGDQSNLRKLRNVSNLKPVPLIGPKLKRRWPISYCRELKGYSIPFMGSDVSVVRRTQRYLYENLEESPVQYAAYVTVGGITSVIKLMFAGLFFLFFVRFGIGRQLLIKFPWFFSFGYFSKQGPTQKQIDAASFTLTFFGQGYSQGTGTDKNKPNIKICTQVKGPEAGYVATPIAMVQAAMTLLSDASHLPKAGGVFTPGAAFSKTKLIDRLNKHGIEFSVISSSEV

SEQ ID NO: 208 - protein, 485 aa, Homo sapiens
MEFLGTTQTASYCGPKKCCGLTSLPAVQAPVIQECYQPYYLPGYRYLNSWRPSLFYKIANVQTCPDESTSTLRPPTILPTLRSALFSRYSPHDWDQSNQLQVRGAEASRLWASRLTDDSMRLLQDKDQLTHQMQEGTCRNLGQRLSDIGFWKSELSYELDRLLTENQNLETVKRRLECAANEVNCPLQVALECLYHREKRIGIDLVHDNVEKNLIREVDLLKCCQEQMRKLAQRIDIQMRDNRDAQHVLERDLEDKSSAQCIDEKCFNLRNTSDCISFFHGMEKIDGTISVPETWAKFSNDNIKHSQNMRANSIQLREEAEHLFETLSDQMWRQFTDTNLAFNARISEVTDVKNKLQTQLAKTLQEIFQAENTIMLLERSIMAKEGPLKVAQTRLECRTRRPNMELCRDIPQLKLVNEVFTIDDTLQTLKLRLRETQDTLQLLVMTKCRLEHELAIKANTLCIDKEKCMGMRKTFPCTPRLVGHT

SEQ ID NO: 209 - protein, 825 aa, Homo sapiens
MVGKSQQTDVIEKKKHMAIPKSSSPKATHRIGNTSGSKGSYSAKAYESIRVSSELQQTWTKRKHGQEMTSKSLQTDTIVEEKKEVKLVEETVVPEEKSADVREAAIELPESVQDVEIPPNIPSVQLKMDRSQQTSRTGYWTMMNIPPVEKVDKEQQTYFSESEIVVISRPDSSSTKSKEDALKHKSSGKIFASEQPEFQPATNSNEEIGQKNISRTSFTQETKKGPPVLLEDELREEVTVPVVQEGSAVKKVASAEIEPPSTEKFPAKIQPPLVEEATAKAEPRPAEETHVQVQPSTEETPDAEAATAVAENSVKVQPPPAEEAPLVEFPAEIQPPSAEESPSVELLAEILPPSAEESLSEEPPAEILPPPAEKSPSVEPLGEIRSPSAQKAPIEVQPLPAEGALEEASAKVEPPTVEETLADVQPLLPEEAPREEARELQLSTAMETPAEEAPTEFQSPLPKETTAEEASAEIQLLAATEPPADETPAEARSPLSEETSAEEAHAEVQSPLAEETTAEEASAEIQLLAAIEAPADETPAEAQSPLSEETSAEEAPAEVQSPSAKGVSIEEAPLELQPPSGEETTAEEASAAIQLLAATEASAEEAPAEVQPPPAEEAPAEVQPPPAEEAPAEVQPPPAEETPAEVQPPPAEEAPAEVQPPPAEEAPAEVQPPPAEEAPAEVQSLPAEETPIEETLAAVHSPPADDVPAEEASVDKHSPPADLLLTEEFPIGEASAEVSPPPSEQTPEDEALVENVSTEFQSPQVAGIPAVKLGSVVLEGEAKFEEVSKINSVLKDLSNTNDGQAPTLEIESVFHIELKQRPPEL

SEQ ID NO: 210 - protein, 435 aa, Homo sapiens
MKPKPRILSIKSTSSAENNSLDTDDHFKPSPWPRSMLKKKSHMEEKDGLEDKETALSEELELHSAPSSLPTPNGIQLEAEKKAFSENLDPEDSCLTSLASSSLKQILGDSFSPGSEGNASGKDPNEEITENHNSLKSDENKENSFSADHVTTAVEKSKESQVTADDLEEEKAKAELIMDDDRTVDPLLSKSQSILISTSATASSKKTIEDRNIKNKKSTNNRASSASARLMTSEFLKKSSSKRRTPSTTTSSHYLGTLKVLDQKPSQKQSIEPDRADNIRAAVYQEWLEKKNVYLHEMHRIKRIGSENLRIQNEQKKAAKREEALASFEAWKAMKEKEAKKIAAKKRLEEKNKKKTEEENAARKGEALQAFEKWKEKKMEYLKEKNRKEREYERAKKQKEEETVAEKKKDNLTAVEKWNEKKEAFFKQKEKKKKK

SEQ ID NO: 211 - protein, 267 aa, Homo sapiens
MKPNLDGVDLFNNGGSGNGETKTGLRLKAINLPLENEVTEISALQVHLDEFQKILWKEREMRTALEKEIERLESALSLWKWRYEELKESKPKNVKEFDILLGQHNDEMQELSGNIKEESKSQNSKDRVICELRAELERLQAENTSEWDKREILEREKQGLERENRRLKIQVKEMEELLDKKNRLSANSQSPDFKMSQIDLQEKNQELLNLQHAYYKLNRQYQANIAELTHANNRVDQNEAEVKKLRLRVEELKQGLNQKEDEVLLYE

SEQ ID NO: 212 - protein, 555 aa, Homo sapiens
MDVSSEHTKDPGGEGGDGESLAARPSKIKASSGPPTSPEPGELESEPEEEEEEQAASQGGTAADEQAEAPKGLTAAEAAGEEGPGEPGRPAEPQPEPEEPAEVGAEEPAQPEPGAGPEELEAEAGAEELEQAAEGKEVRFQASLPLTRIDEEEAAAAPEAETERVEGEEEDKEETQRDGAESKERDGEGRPAKSQEEGKRLYGRDEFEDLEWSEEVQKLQEQQLRSDLLDQYRSLLVERNRSQRYNLYLQHKIFEALRRKKGLEAAEVADRGAEAEAPEKEQAYLRHLGMLEELKKQQADDLQWYHQELGQLKRQCQEKLTRVEKEWRRFQALKKQVVMQAMGSCRMRGGRQAALREVEQIQALEDKKEKEMSAVRLENIQLKQSLVHFETRMRTQEDLTQGLLLIDFEQLKIENQTFNEKIEERNEELLKLRSKVTNSVQVITHVKEKLHFMDMENACKKTQLAEIEAQAALGRDILTKTKQAREGLRTDNIRLNQKCGLLGKDSLLRDLEEKVDKTELLHRRLESLKRHHASLTLSCRGVRQKIREAKAFLPS

SEQ ID NO: 213 - protein, 79 aa, Homo sapiens
MNGFGRLEHFSGAVYEGQFKDNMFHGLGTYTFPNGAKYTGNFNENRVEGEGEYTDIQGLEWSGNFHFTAAPDLKLKLHM

SEQ ID NO: 214 - protein, 498 aa, Homo sapiens
MEDGKRERWPTLMERLCSDGFAFPQYPIKPYHLKRIHRAVLHGNLEKLKYLLLTYYDANKRDRKERTALHLACATGQPEMVHLLVSRRCELNLCDREDRTPLIKAVQLRQEACATLLLQNGANPNITDFFGRTALHYAVYNEDTSMIEKLLSHGTNIEECSKCEYQPLLFAVSRRKVKMVEFLLKKKANVNAIDYLGRSALIHAVTLGEKDIVILLLQHNIDVLSRDAFRKIAGDYAIEAKNRVIFDLIYEYERKRYEDLPINSNPVSSQKQPALKATSGKEDSISNIATEIKDGQKSGTVSSQKQPALKDTSDKDDSVSNTATEIKDEQKSGTVLPAVEQCLNRSLYRPDAVAQPVTENEFSLESEIISKLYIPKRKIISPRSIKDVLPPVEEAVDRCLYLLDRFAQPVTKDKFALESENISEPYFTNRRTISQQSAENLDAACGIDKTENGNMFEDQNVDKEGKALPATGQKANVSPEQPPLFTNLLSDLLYPRLL

SEQ ID NO: 215 - protein, 168 aa, Homo sapiens
MNEVKESLRSIEQKYKLFQQQQLTFTAALEHCRENAHDKIRPISSIGQVQSYMEHYCNSSTDRRVLLMFLDICSELNKLCQHFEAVHSGTPVTNNLLEKCKTLVSQSNDLSSLRAKYPHDVVNHLSCDEARNHYGGVVSLIPLILDLMKEWIAHSEKLPRKVLQHGTT

SEQ ID NO: 216 - protein, 1173 aa, Homo sapiens
MSRGSIEIPLRDTDEVIELDFDQLPEGDEVISILKQEHTQLHIWIALALEYYKQGKTEEFVKLLEAARIDGNLDYRDHEKDQMTCLDTLAAYYVQQARKEKNKDNKKDLITQATLLYTMADKIIMYDQNHLLGRACFCLLEGDKMDQADAQFHFVLNQSPNNIPALLGKACISFNKKDYRGALAYYKKALRTNPGCPAEVRLGMGHCFVKLNKLEKARLAFSRALELNSKCVGALVGLAVLELNNKEADSIKNGVQLLSRAYTIDPSNPMVLNHLANHFFFKKDYSKVQHLALHAFHNTEVEAMQAESCYQLARSFHVQEDYDQAFQYYYQATQFASSSFVLPFFGLGQMYIYRGDKENASQCFEKVLKAYPNNYETMKILGSLYAASEDQEKRDIAKGHLKKVTEQYPDDVEAWIELAQILEQTDIQGALSAYGTATRILQEKVQADVPPEILNNVGALHFRLGNLGEAKKYFLASLDRAKAEAEHDEHYYNAISVTTSYNLARLYEAMCEFHEAEKLYKNILREHPNYVDCYLRLGAMARDKGNFYEASDWFKEALQINQDHPDAWSLIGNLHLAKQEWGPGQKKFERILKQPSTQSDTYSMLALGNVWLQTLHQPTRDREKEKRHQDRALAIYKQVLRNDAKNLYAANGIGAVLAHKGYFREARDVFAQVREATADISDVWLNLAHIYVEQKQYISAVQMYENCLRKFYKHQNTEVVLYLARALFKCGKLQECKQTLLKARHVAPSDTVLMFNVALVLQRLATSVLKDEKSNLKEVLNAVKELELAHRYFSYLSKVGDKMRFDLALAATEARQCSDLLSQAQYHVARARKQDEEERELRAKQEQEKELLRQKLLKEQEEKRLREKEEQKKLLEQRAQYVEKTKNILMFTGETEATKEKKRGGGGGRRSKKGGEFDEFVNDDTDDDLPISKKKKRRKGSGSEQEGEDEEGGERKKKKRRRHPKGEEGSDDDETENGPKPKKRRPPKAEKKKAPKPERLPPSMKGKIKSKAIISSSDDSSDEDKLKIADEGHPRNSNSNSDSDEDEQRKKCASSESDSDENQNKSGSEAGSPRRPRRQRSDQDSDSDQPSRKRRPSGSEQSDNESVQSGRSHSGVSENDSRPASPSAESDHESERGSDNEGSGQGSGNESEPEGSNNEASDRGSEHGSDDSD

SEQ ID NO: 217 - protein, 412 aa, Homo sapiens
MTFTFQSEDLKRDCGKKMSHQHVFSLAMEEDVKTADTKKASRILDHEKENTRSICLLEQKRKVVSSNIDVPPARKSSEELDMDKVTAAMVLTSLSTSPLVRSPPVRPNESLSGSWKEGGCVPSSTSSSGYWSWSAPSDQSNPSTPSPPLSADSFKPFRSPAQPDDGIDEAEASNLLFDEPIPRKRKNSMKVMFKCLWKNCGKVLSTAAGIQKHIRTIHLGRVGDSDYSDGEEDFYYTEIKLNTDSVADGLSSLAPVSPSQSLASPPTFPIPDSSRTETPCAKTETKLMTPLSRSAPTTLYLVHTDHAYQATPPVTIPGSAKFTPNGSSFSISWQSPPVTFTGIPVSPTHHPVGTGEQRQHAHTVLSSPPRGTVSLRKPRGEGKKCRKVYGMENRDMWCTACRWKKACQRFLD

SEQ ID NO: 218 - protein, 381 aa, Homo sapiens [sequence omitted]

SEQ ID NO: 219 - protein, 351 aa, Homo sapiens
MATDVQLADYPLMSPKAELKLEKKSGRKPRSPRDSGPQKELVIPGIVDFERIRRALRTPKPQTPGTYCFGRLSHHSFFSRHHPHPQHVTHIQDLTGKPVCVVRDFPAPLPESTVFSGCQMGIPTISVPIGDPQSNRNPQLSSEAWKKELKELASRVAFLTKEDELKKKEKEQKEEPLREQGAKYSAETGRLIPASTRAVGRRRSHQGQQSQSSSRHEGVQAFLLQDQELLVLELLCQILETDLLSAIQFWLLYAPPKEKDLALGLLQTAVAQLLPQPLVSIPTEKLLSQLPEVHEPPQEKQEPPCSQSPKKTKISPFTKSEKPEYIGEAQVLQMHSSQNTEKKTSKPRAES

SEQ ID NO: 220 - protein, 802 aa, Homo sapiens
KGTMSKKGRNKGEKPEALIVALQAANEDLRTKLTDIQIELHQEKSKVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLMDEIKAKDRIIFSLEKELETQTGYVQKLQLQKEALDEQLFLVKEAECNMSSPKREIPGRAGDGSEHCSSPDLRRNQKRIAELNATIRKLEDRNTLLGDERNELLKRVRETEKQCKPLLERNKCLAKRNDELMVSLQRMEEKLKAVTKENSEMREKITSHPPLKKLKSLNDLDQANEEQETEFLKLQVIEQQNIIDELTRDREKLIRRRKHRRSSKPIKRPVLDPFIGYDEDSMDSETSSMASFRTDRTPATPDDDLDESLAAEESELRFRQLTKEYQALQRAYALLQEQTGGIIDAEREAKAQEQLQAEVLRYKAKIEDLEATLAQKGQIEKQEAENHRLQQELQDARDQNELLEFRNLELEERERRSPPFNLQIHPFSDGVSALQIYCMKEGVKDVNIPDLIKQLDILGDNGNLRNEEQVAIIQASTVLSLAEKWIQQIEGAEAALHQKMMELESDMEQFCKIKGYLEEELDYRKQALDQAYMRIQELEATLYNALQQETVIKFGELLSEKQQEELRTAVEKLRRQMLRKSREYDCQILQERMELLQQAHQRIRDLEDKTDIQKRQIKDLEEKFLFLFLFFSLAFILWP

What is claimed is:

1. A method of identifying a candidate agent that is protective against oxidative DNA damage in a subject, the method comprising:
(i) obtaining a mutator bacterial strain that (a) has a spontaneous mutation rate and (b) comprises a mutation reporter that can produce a spectrophotometrically and/or fluorescently detectable product;
(ii) contacting the mutator bacterial strain with a test compound; and
(iii) evaluating the spontaneous mutation rate of the mutator strain using the mutation reporter;
wherein a decrease in the spontaneous mutation rate indicates that the test compound is a candidate compound that is protective against oxidative DNA damage in a subject.

2. The method of claim 1, wherein the subject is a mammal.

3. The method of claim 1, wherein the subject is a human.

4. The method of claim 1, further comprising testing the candidate compound in an animal model of oxidative DNA, wherein a compound that prevents or reduces oxidative DNA damage in the animal model is a candidate protective agent against oxidative DNA damage.

5. The method of claim 1, wherein the reporter comprises a coding sequence for any one of the following: β-galactosidase, luciferase, green fluorescent protein, chloramphenicol, acetyltransferase, β-glucuronidase, exoglucanase and glucoamylase.

6. The method of claim 5, wherein the reporter is a lacZ coding sequence that includes a substitution in the codon encoding amino acid Glu-461 of E. coli β-galactosidase.

7. A method of identifying a nucleic acid sequence that is protective against oxidative DNA damage, the method comprising:
(i) obtaining a collection of nucleic acid molecules encoding a plurality of gene products;
(ii) transforming the collection into a spontaneous mutator bacterial strain that (a) has a spontaneous mutation rate and (b) comprises a mutation reporter that can produce a spectrophotometrically and/or fluorescently detectable product; and
(iii) screening individual transformants using the mutation reporter for a decrease in the spontaneous mutation rate of the mutator strain;
wherein a transformant that exhibits a decreased spontaneous mutation rate indicates that the nucleic acid sequence in the transformant is protective against oxidative damage.

8. The method of claim 7, wherein the nucleic acid sequence is from a mammal.

9. The method of claim 7, wherein the nucleic acid sequence is from a human.

10. The method of claim 7, wherein the reporter comprises a coding sequence for any one of the following: β-galactosidase, luciferase, green fluorescent protein, chloramphenicol acetyltransferase, beta-glucuronidase, exoglucanase and glucoamylase.

11. The method of claim 10, wherein the reporter is a lacZ coding sequence that includes a substitution in the codon encoding amino acid Glu-461 of *E. coli*β-galactosidase.

12. The method of claim 7, wherein the method is performed using high-throughput screening techniques.

13. The method of claim 7, wherein each nucleic acid molecule comprises a human cDNA sequence and wherein the method is performed using high-throughput screening techmques.

14. The method of claim 7, further comprising characterizing the nucleic acid sequence in a transformant with a decreased mutation rate.

15. A method of identifying a subject at increased risk for oxidative DNA damage, the method comprising:
   (i) isolating genetic material from the subject; and
   (ii) determining whether the genetic material of the subject comprises a mutant allele of a gene sequence identified by the method of claim 7;
   wherein a determination that the genomic material comprises a mutant allele indicates that the subject has an increased risk for oxidative DNA damage relative to a population of subjects with a normal allele of the gene sequence.

16. The method of claim 15, wherein step (i) further comprises amplifying the genetic material from the subject.

17. The method of claim 15, wherein the determination of whether the genetic material harbors a mutant allele comprises any one or more of the following: direct DNA sequencing (DS), denaturing high performance liquid chromatography (DHPLC), single-strand conformation polymorphism (SSCP), denaturing gradient gel electrophoresis (DGGE), heteroduplex analysis (HA), fluorescent assisted mismatch analysis (FAMA), and the protein truncation test (PTT).

18. The method of claim 15, wherein the gene sequence is selected from nucleic acid sequences encoding polypeptides comprising SEQ ID NOs:11-220.

19. The method of claim 18, wherein the gene sequence is a nucleic acid sequence encoding SEQ ID NO:17.

20. The method of claim 15, wherein the determination of whether the genetic material harbors a mutant allele comprises determining whether the genetic material harbors a marker linked to the mutant allele.

21. A method of identifying a subject at increased risk for oxidative DNA damage, the method comprising:
   (i) isolating genetic material from the subject; and
   (ii) determining whether the genetic material of the subject comprises a mutant allele of one or more gene sequences selected from nucleic acid sequences encoding polypeptides comprising SEQ ID NOs:11-220, whose normal allele is protective against oxidative DNA damage;
   wherein a determination that the genomic material comprises a mutant allele indicates that the subject has an increased risk for oxidative DNA damage relative to a population of subjects with a normal allele of the gene sequence.

22. The method of claim 21, wherein the one or more gene sequences includes a nucleic acid sequence encoding SEQ ID NO:17.

* * * * *

UNITED STATES PATENT AND TRADEMARK OFFICE
CERTIFICATE OF CORRECTION

PATENT NO. : 7,560,233 B2
APPLICATION NO. : 11/154012
DATED : July 14, 2009
INVENTOR(S) : Michael Volkert It is certified that error appears in the above-identified patent and that said Letters Patent is hereby corrected as shown below:

Title page, item (56), column 2, line 2, replace "TFIIH," with --TFIIH,--

Column 49, line 10, replace "*E. coliβ*-galactosidase." with --*E. coli β*-galactosidase.--

Column 49, line 16, replace "techmques." with --techniques.--

Signed and Sealed this

Tenth Day of November, 2009

David J. Kappos
*Director of the United States Patent and Trademark Office*